US010851359B2

(12) United States Patent
Gerardy-Schahn et al.

(10) Patent No.: US 10,851,359 B2
(45) Date of Patent: Dec. 1, 2020

(54) ANTI-TUMOR MEDICAMENT BASED ON ADENOVIRUS

(71) Applicant: MEDIZINISCHE HOCHSCHULE HANNOVER, Hannover (DE)

(72) Inventors: Rita Gerardy-Schahn, Hiddenhausen (DE); Florian Kuehnel, Hannover (DE); Nikolas Martin, Springe (DE); David Schwarzer, Hannover (DE)

(73) Assignee: Medizinische Hochschule Hannover, Hannover (DE)

( * ) Notice: Subject to any disclaimer, the term of this patent is extended or adjusted under 35 U.S.C. 154(b) by 157 days.

(21) Appl. No.: 15/560,076

(22) PCT Filed: Mar. 24, 2016

(86) PCT No.: PCT/EP2016/056627
§ 371 (c)(1),
(2) Date: Sep. 20, 2017

(87) PCT Pub. No.: WO2016/156239
PCT Pub. Date: Oct. 6, 2016

(65) Prior Publication Data
US 2018/0163190 A1    Jun. 14, 2018

(30) Foreign Application Priority Data

Mar. 27, 2015 (EP) .................................... 15161545
Apr. 24, 2015 (EP) .................................... 15165130

(51) Int. Cl.
| | | |
|---|---|---|
| C12N 9/24 | (2006.01) | |
| C07K 14/005 | (2006.01) | |
| A61K 35/761 | (2015.01) | |
| A61K 38/16 | (2006.01) | |
| A61P 35/00 | (2006.01) | |
| C12N 15/86 | (2006.01) | |

(52) U.S. Cl.
CPC .......... *C12N 9/2402* (2013.01); *A61K 35/761* (2013.01); *A61K 38/162* (2013.01); *A61P 35/00* (2018.01); *C07K 14/005* (2013.01); *C12N 15/86* (2013.01); *C12Y 302/01129* (2013.01); *C07K 2319/00* (2013.01); *C07K 2319/035* (2013.01); *C07K 2319/33* (2013.01); *C12N 2710/10043* (2013.01); *C12N 2710/10071* (2013.01); *C12N 2710/10322* (2013.01); *C12N 2710/10332* (2013.01); *C12N 2795/00022* (2013.01); *C12N 2795/00043* (2013.01); *C12N 2795/00071* (2013.01)

(58) Field of Classification Search
CPC .................. C12N 9/2402; C12N 15/86; C12N 2710/10043; C12N 2710/10071; C12N 2710/10322; C12N 2710/10332; C12N 2795/00022; C12N 2795/00043; C12N 2795/00071; A61K 35/761; A61K 38/162; A61P 35/00; C07K 14/005; C07K 2319/00; C07K 2319/035; C07K 2319/33; C12Y 302/01129
See application file for complete search history.

(56) References Cited

U.S. PATENT DOCUMENTS

| | | | | |
|---|---|---|---|---|
| 2005/0095231 | A1* | 5/2005 | Curiel | ...................... C12N 7/00 424/93.21 |
| 2006/0228334 | A1* | 10/2006 | Rosa-Calatrava | ..... C12N 15/86 424/93.2 |
| 2011/0189234 | A1 | 8/2011 | Van Beusechem et al. | |

FOREIGN PATENT DOCUMENTS

| | | |
|---|---|---|
| WO | 199702351 | 1/1997 |
| WO | 199854346 | 12/1998 |
| WO | 200208263 A2 | 1/2002 |
| WO | 2004007537 A2 | 1/2004 |
| WO | WO-2013010660 A1 * | 1/2013 ..... C12Y 302/01129 |

OTHER PUBLICATIONS

Jacokbsson et al. "Identification of amino acid residues at the active site of endosialidase that dissociate the polysialic acid binding and cleaving activities in *Escherichia coli* K1 bacteriophages." Biochem J. Aug. 1, 2007;405(3):465-72. (Year: 2007).*
Stummeyer et al. "Crystal structure of the polysialic acid-degrading endosialidase of bacteriophage K1F." Nat Struct Mol Biol. Jan. 2005;12(1):90-6. Epub Dec. 19, 2004. (Year: 2005).*
Hashimoto et al. "The hTERT Promoter Enhances the Antitumor Activity of an Oncolytic Adenovirus under a Hypoxic Microenvironnment." PLoS One. 2012;7(6):e39292. (Year: 2012).*
Kavoosi et al. "Strategy for selecting and characterizing linker peptides for CBM9-tagged fusion proteins expressed in *Escherichia coli*." Biotechnol Bioeng. Oct. 15, 2007;98(3):599-610. (Year: 2007).*
Niklas Arnberg, "Adenovirus receptors: implications for tropism, treatment and targeting", Reviews in Medical Virology, No. 19, pp. 165-178, Apr. 14, 2009.
Siobhan M. Cashman et al., "Adenovirus type 5 pseudotyped with adenovirus type 37 fiber uses sialic acid as a cellular receptor", Virology, No. 324, pp. 129-139, 2004.

(Continued)

*Primary Examiner* — Titilayo Moloye
(74) *Attorney, Agent, or Firm* — Greer, Burns & Crain, Ltd.; Steven P. Fallon

(57) ABSTRACT

The invention provides manipulated adenovirus, i.e. a viral particle based on a manipulated adenovirus, for use as a medicament, especially for use in the treatment of tumours. The viral particle of the invention has the advantage of having a preference or specificity for tumour cells, yielding a preferred infection of tumour cells. The viral particle is based on adenovirus, especially type C, preferably serotype 2 (Ad2), more preferably serotype 5 (Ad5), in which the native entire fiber protein, and its coding sequence, respectively, is deleted and replaced by a fusion protein providing specificity for cell surface bound polysialic acid.

Figure 1:
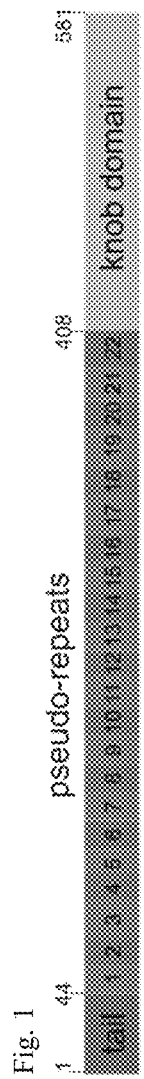

16 Claims, 13 Drawing Sheets
Specification includes a Sequence Listing.

(56) References Cited

OTHER PUBLICATIONS

Timothy P. Cripe et al., "Fiber Knob Modifications Overcome Low, Heterogeneous Expression of the Coxsackievirus-Adenovirus Receptor That Limits Adenovirus Gene Transfer and Oncolysis for Human Rhabdomyosarcoma Cells", Cancer Research, No. 61, pp. 2953-2960, Apr. 1, 2001.

JN Glasgow et al., "Transductional targeting of adenovirus vectors for gene therapy", Cancer Gene Therapy, No. 13, pp. 830-844, 2006.

Arnold Kloos et al., "PolySia-Specific Retargeting of Oncolytic Viruses Triggers Tumor-Specific Immune Responses and Facilitates Therapy of Disseminated Lung Cancer", American Association for Cancer Research Journals, Cancer Immunology Research, pp. 751-763, published Feb. 19, 2015.

Victor Krasnykh et al., "Genetic Targeting of an Adenovirus Vector via Replacement of the Fiber Protein with the Phage T4 Fibritin", Journal of Virology, vol. 75, No. 9, pp. 4176-4183, May 2001.

Florian Kuhnel et al., "Protein Transduction Domains Fused to Virus Receptors Improve Cellular Virus Uptake and Enhance Oncolysis by Tumor-Specific Replicating Vectors", Journal of Virology, vol. 78, No. 24, pp. 13743-13754, Dec. 2004.

George T. Mercier et al., "A chimeric adenovirus vector encoding reovirus attachment protein σ1 targets cells expressing junctional adhesion molecule 1", PNAS, vol. 101, No. 16, pp. 6188-6193, Apr. 20, 2004.

Frederik H.E. Schagen et al., "Replacement of Native Adenovirus Receptor-Binding Sites with a New Attachment Moiety Diminishes Hepatic Tropism and Enhances Bioavailability in Mice", Human Gene Therapy, No. 19, pp. 783-794, Aug. 2008.

Eike Christian Schulz et al., Structural Basis for the Recognition and Cleavage of Polysialic Acid by the Bacteriophage K1F Tailspike Protein EndoNF, Journal of Molecular Biology, No. 397, pp. 341-351, 2010.

David Schwarzer et al., "Characterization of a Novel Intramolecular Chaperone Domain Conserved in Endosialidases and Other Bacteriophage Tail Spike and Fiber Proteins", The Journal of Biological Chemistry, vol. 282, No. 5, pp. 2821-2831, Feb. 2, 2007.

Mary-Jane Staba et al., "Modifications of the fiber in adenovirus vectors increase tropism for malignant glioma models", Cancer Gene Therapy, vol. 7, No. 1, pp. 13-19, 2000.

Katharina Stummeyer et al., "Evolution of bacteriophages infecting encapsulated bacteria: lessons from *Escherichia coli* K1-specific phages", Journal of Molecular Microbiology, vol. 60, No. 5, pp. 1123-1135, Apr. 21, 2006.

Yuko Tsuruta et al., "A Mosaic Fiber Adenovirus Serotype 5 Vector Containing Reovirus σ1 and Adenovirus Serotype 3 Knob Fibers Increases Transduction in an Ovarian Cancer Ex vivo System via a Coxsackie and Adenovirus Receptor-Independent Pathway", American Association for Cancer Research Journals, Clinical Cancer Research, vol. 13, No. 9, pp. 2777-2783, May 1, 2007.

* cited by examiner

Fig. 6

```
EndoPhi92-dN76    GDGATDDTNAITQLLAAMPDGWIIDGRNLTFKVTTLPDISKFKNAAFVYERIVGQPLTYV
EndoNK1-dN147     GDGVHDDTSALSELLSVATGGEKIDGRGLTFKVSTLPDVSRFKNARFLFERIPGQPLFYV
EndoK1F-dN247     GDGVTDDTAALTSALNDTPVGQKINGNGKTYKVTSLPDISRFINTRFVYERIPGQPLYYA
EndoK1E-dN40      GDGKTNDQDAVNAA---MASGKRIDGAGATYKVSSLPDMERFYNTRFVWERLAGQPLYYV
                  ***  ..* *.    *   *.*   *;;**;;***;;.;* *; *;;**; **** *

EndoPhi92-dN76    SEGFFDGNLTKITDTPFYNAWTQDKTFVYDNVIYAPFMAGERHGVQNLHVAWVKSGDDGQ
EndoNK1-dN147     SEDFIQGELFKITDTPWYNAWTQDKTFVYDNVIYAPFMAGDRHGVNNLHVAWVRSGDDGK
EndoK1F-dN247     SEEFVQGELFKITDTPYYNAWPQDKAFVYENVIYAPYMGSDRHGVSRLHVSWVKSGDDGQ
EndoK1E-dN40      SKGFINGELYKITDNPYYNAWPQDKAFVYENVIYAPYMGSDRHGVSRLHVSWVKSGDDGQ
                  *;  * .*.* *** *.**** *.**** ***;*** ;******;.*.,.;**** ***;**.**;*****;

EndoPhi92-dN76    TWSMPEWLTPIHPDYTADKVNYHCMSMGVCGNRLYAVIETRYLSNMRLKKAELWSRPMPY
EndoNK1-dN147     TWTTPEWLTDLHENYP--TVNYHCMSMGVVRNRLFAVIETRTVSGNKLQVAELWDRPMSR
EndoK1F-dN247     TWSTPEWLTDLHPDYP--TVNYHCMSMGVCRNRLFAMIETRTLAKNALTNCALWDRPMSR
EndoK1E-dN40      TWSTPEWLTDMHPDYP--TVNYHCMSMGVCRNRLFAMIETRTLAKNELTNCALWDRPMSR
                  **; *****  ;*  *   **********  ***;*;****  ;;   *     ** ***

EndoPhi92-dN76    YRRPTGGITISSGSTTATIVLKKHGLKVGDAVNFSNSGATGVSGNMTVASVINKDTFTVT
EndoNK1-dN147     SLRVYGGITKAANQQVAYIRITDHGLFAGDFVNFSNSGVTGVTGNMTVTTVIDKNTFTVT
EndoK1F-dN247     SLHLTGGITKAANQRYATIHVPDHGLFVGDFVNFSNSAVTGVSGDMTVATVIDKDNFTVL
EndoK1E-dN40      SLHLTGGITKAANQRYATIHVPDHGLFVGDFVNFSNSAVTGVSGDMKVATVIDKDNFTVL
                  ****  ;;  ,   * *  .***  ** ****** ***;*;*.*;;**;*;.***

EndoPhi92-dN76    LARAATSNIDNTGTTWHFGTRFWDSPWEITELPDVAYSTNADLCVTETHSFTVIDDDNYT
EndoNK1-dN147     TQNTQDVDQNNEGRYWSFGTSFHSSPWRKTSLGTIPSFVDGSTPVTEIHSFATISDN--S
EndoK1F-dN247     TPNQQTSDLNNAGKNWHMGTSFRKSPWRKTDLGLIPS-------VTEVHSFATIDNN--G
EndoK1E-dN40      TPNQQTSDLNNAGKNWHMGTSFHKSPWRKTDLGLIPR-------VTEVHSFATIDNN--G
                   ;*  * * * ;**  *  *** *,*         *** ***;.*.;;

EndoPhi92-dN76    FAVGYHNGDISPRRLGILYFNNAYSDPSSFTRRTISQEYADNAAEPCIKYYDGILYLTTR
EndoNK1-dN147     FAVGYHNGDIGPRELGILYFSDAFGSPGSFVRRRIPAEYEANASEPCVKYYDGILYLTTR
EndoK1F-dN247     FAMGYHQGDVAPREVGLFYFPDAFNSPSNYVRRQIPSEYEPDASEPCIKYYDGVLYLITR
EndoK1E-dN40      FVMGYHQGDVAPREVGLFYFPDAFNSPSNYVRRQIPSEYEPDAAEPCIKYYDGVLYLITR
                  *.;***;**.**.;**.;**.;** (*;  *..;.,** *   **  ;*;****;*****;*** **

EndoPhi92-dN76    GTSTSAAGSTLAMSADLGENWNYLRFPNNVHHTNLPFAKVGDYLYIFGTERSFGEWEGQE
EndoNK1-dN147     GTLSTQPGSSLHRSSDLGTSWNSLRFPNNVHHSNLPFAKVGDELIIFGSERAFGEWEGGE
EndoK1F-dN247     GTRGDRLGSSLHRSRDIGQTWESLRFPHNVHHTTLPFAKVGDDLIMFGSERAENEWEAGA
EndoK1E-dN40      GTRGDRLGSSLHRSRDIGQTWESLRFPHNVHHTTLPFAKVGDDLIMFGSERAENEWEAGA
                  **      *** *  *  * *;  **** **** ;********  * ;**;**;  ***

EndoPhi92-dN76    LDNRYKGTYPRTFMCKINVSSWPVSLSNVQWFNITDQIYQGHIVNSACGVGSVCVKDGWL
EndoNK1-dN147     PDNRYAGNYPRTFMTRVNVNEWS--LDNVEWVNVTDQIYQGGIVNSAVGVGSVCIKDNWL
EndoK1F-dN247     PDDRYKASYPRTFYARLNVNNWN--ADDIEWVNITDQIYQGGIVNSGVGVGSVVVKDNYI
EndoK1E-dN40      PDDRYKASYPRTFYARLNVNNWN--ADDIEWVNITDQIYQGDIVNSSVGVGSVVVKDSFI
                   *;** ***** ;;;**  *     ,.;;;*,*;******  **** ***** ;**  ;;

EndoPhi92-dN76    YYIFGGEDFLSPWSIGDNSKKLWYKHDGHPADLYSYRLKITEHDFVSRDFKYGATPNRTL
EndoNK1-dN147     YYIFGGEDFLNPWSIGDNNRKYPYVRDGHPADLYCFRVKIKQEEFVSRDFVYGATPNRTL
EndoK1F-dN247     YYMFGGEDHFNPWTYGDNSAKDPFKSDGHPSDLYCYKMKIGPDNRVSRDFRYGAVPNRAV
EndoK1E-dN40      YYIFGGENHFNPMTYGDNKDKDPFKSEHGHPTDIYCYKMQIANDNRVSRKFTYGATPGQAI
                  **;*****;,.;*   *** *  ***  ***;*.*;.;;;;*  ,; ***,* ***.* (;;

EndoPhi92-dN76    PVSMGTDGVRHVSAPVTFDNDVQMYSLTVTGLEHD--GTQQSAVRVKLDGDYGVIAKNIP
EndoNK1-dN147     PTFMSTSGVRTVPVPVDFTD-----DVAVQSLTVHAGTSGQVRAEVKLEGNYAIIAKKVP
EndoK1F-dN247     PVFFDTNGVRTVPAPMEFTG-----DLGLGHVTIRASTSSNIRSEVLMEGEYGFIGKSIP
EndoK1E-dN40      PTFMGTDGIRNIPAPLYFSDNIVTEDTKVGHLTLKASTSANIRSEMQMEGEYGFIGKSVP
                  *   * *.*  ; ,*;  *                ;;;*** ,*,*.,*,*;*
```

Fig. 6 continued

```
EndoPhi92-dN76     IKNPSEQRLILCGGETPYTTDGSLLQLYGSNHTYPNRAILYAPGGAYTQNNFMPYLDGQV
EndoNK1-dN147                                IALEHLFENGDVKPYLDNVN
EndoK1F-dN247                                IGDEHLFQSADVKPYNDNVT
EndoK1E-dN40                                 IGNEHLFQGAPIMPAVDNQF
                                                  .   :    * *

EndoPhi92-dN76     SLCGASNRWSEVYASTGTINT----------------------------------
EndoNK1-dN147      ALGGPGNRFSIVYLGSNPVVTSDGTLKTEPVSPDETLLDAWGDVRYIAYKWLNAVAIKGE
EndoK1F-dN247      ALGGPSNRFTTAYLGSNPIVTSNGERKTEPVVFDDAFLDAWGDVHYIMYQWLDAVQLKGN
EndoK1E-dN40       AAGGPSNRFTTIYLGSDPVTTSDADHKYGISSINTKVLKAWSRVGFKQYGLNS--EAERN
                   . **  **:;   *  ::    *

EndoPhi92-dN76     ------------------------------------------------------------
EndoNK1-dN147      EGARIHHGVIAQQLRDVLISHGLMEEESTTCRYAFLCYDDYPAVYDDVITGQREMPLTDN
EndoK1F-dN247      -DARIHFGVIAQQIRDVFIAHGLMDENSTNCRYAVLCYDKYPRMTDTVFSHNEIVEHTDE
EndoK1E-dN40       -LDSIHFGVLAQDIVAAFEAEGLDAI-----KYGIVSF-----------------------

EndoPhi92-dN76     ------------------------------------------------------------
EndoNK1-dN147      DGSIIVDEDDNPVMVMEDIIERVEITPAGSRWGVRPDLLFYIEAAWQRREIERIKARLDL
EndoK1F-dN247      EGNVTTT--------EEPVYTEVVIHEEGEEWGVRPDGIFFAEAAYQRRKLERIEARLSA
EndoK1E-dN40       ---------------------------------EEGRYGVRYSEVLILEAAYTRHRLDKLEEMYAT EndoPhi92-dN76     -----
EndoNK1-dN147      IEGKH
EndoK1F-dN247      LEQK-
EndoK1E-dN40       NKIS-
```

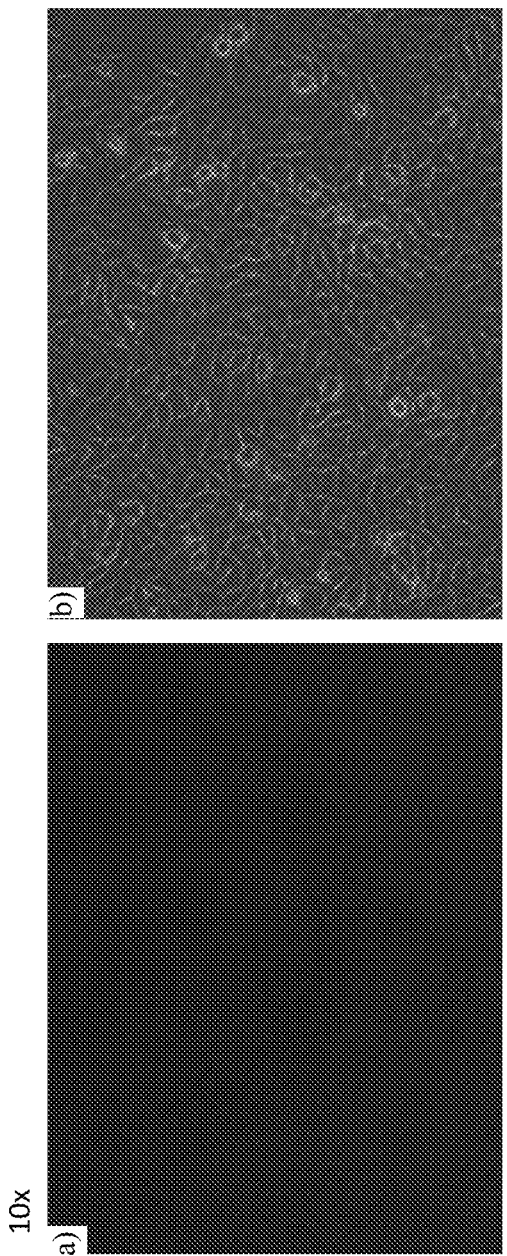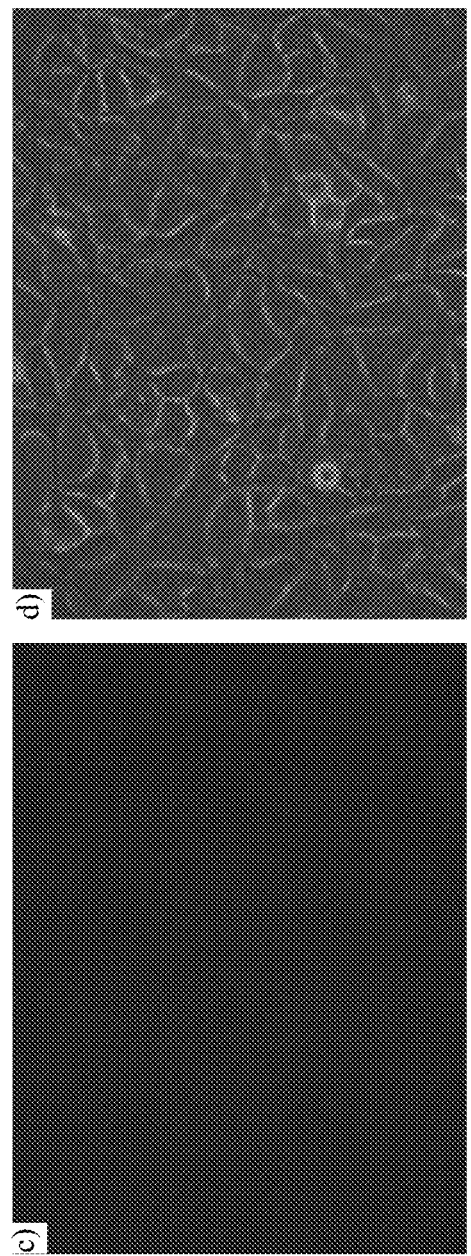
Fig. 10A  Fig. 10B  Fig. 10C  Fig. 10D

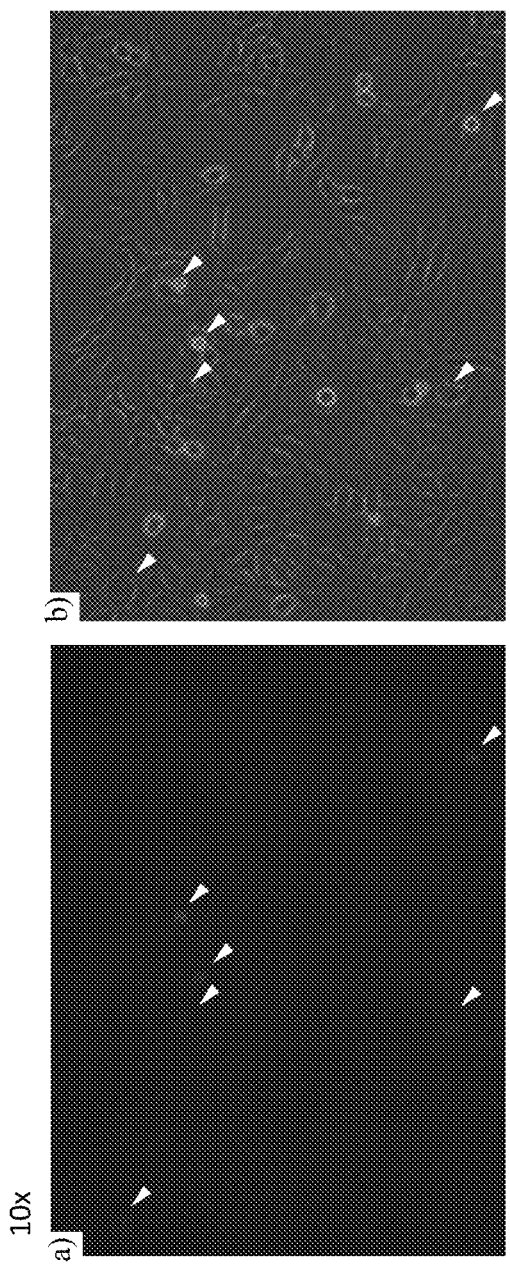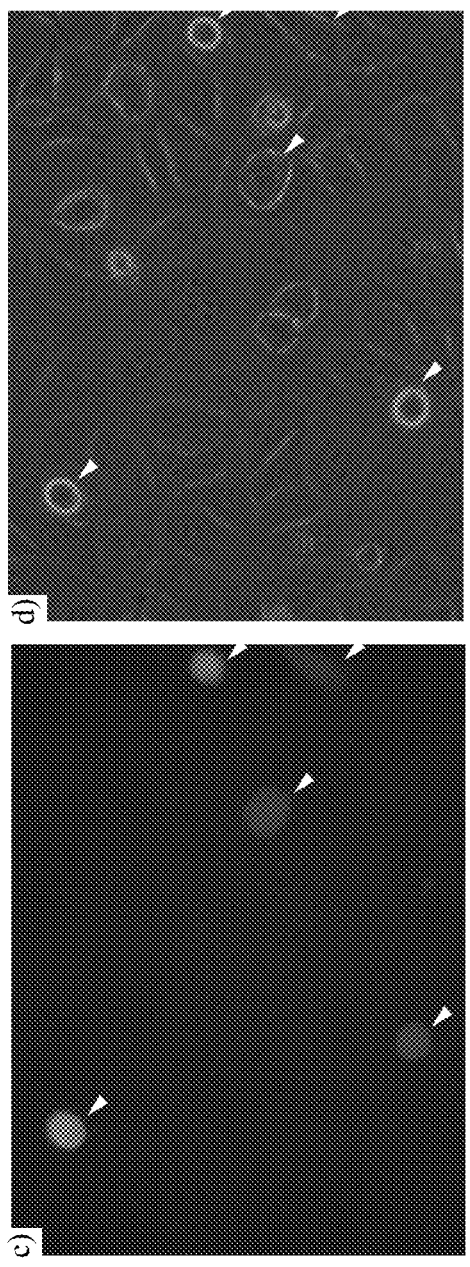
Fig. 11A Fig. 11B Fig. 11C Fig. 11D

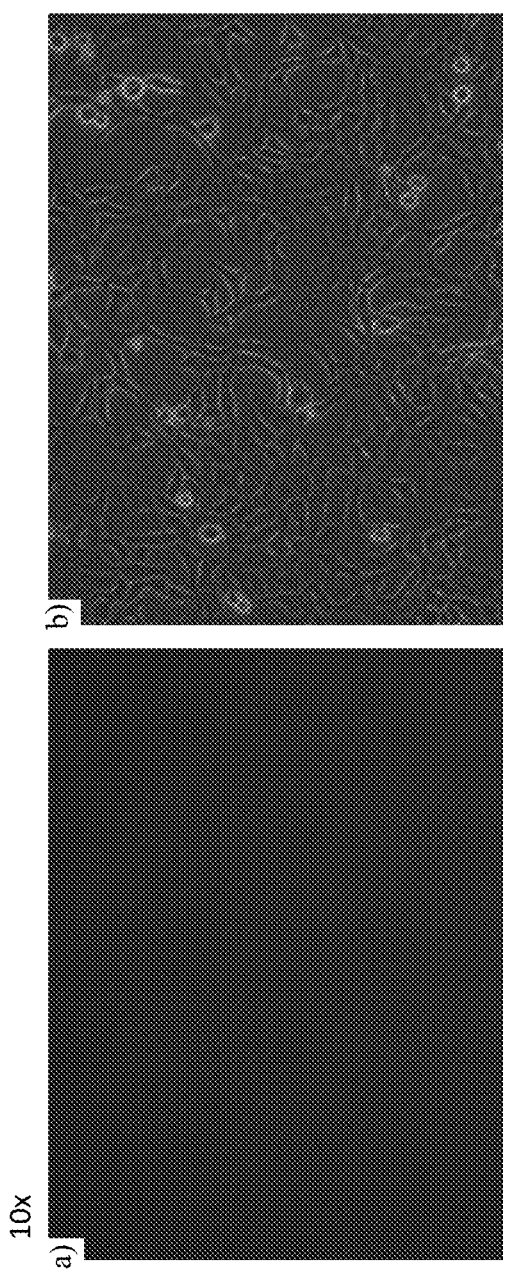
Fig. 12A
Fig. 12B
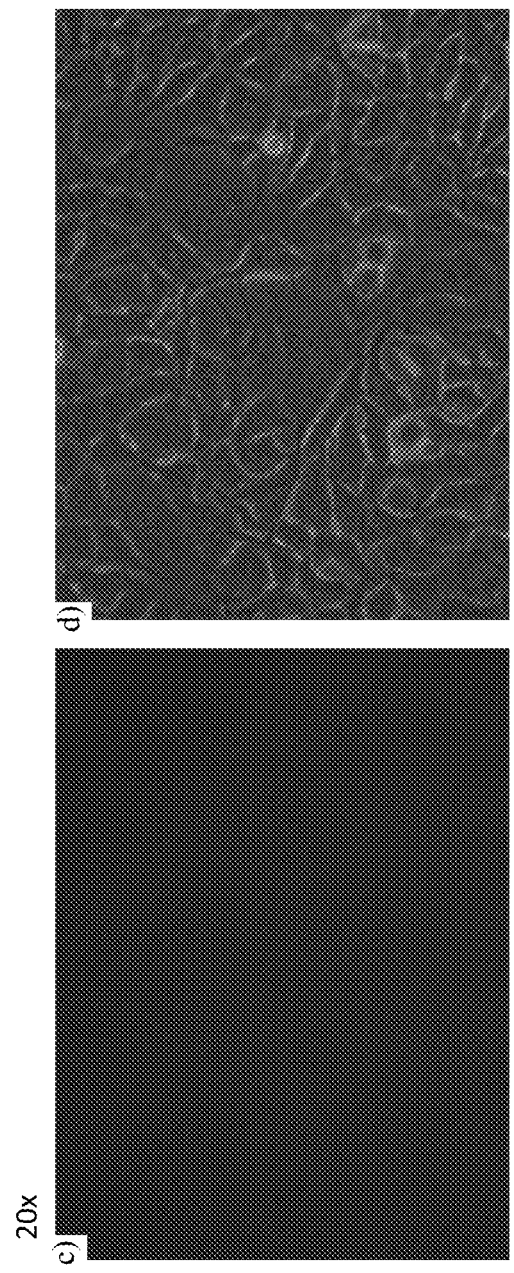
Fig. 12C
Fig. 12D

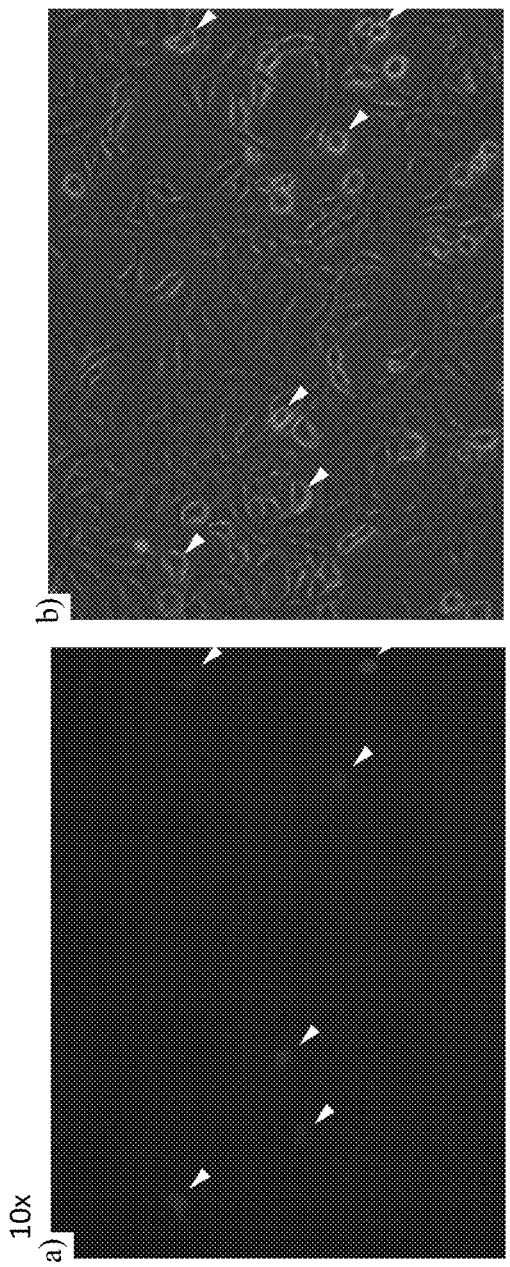
Fig. 13A
Fig. 13B
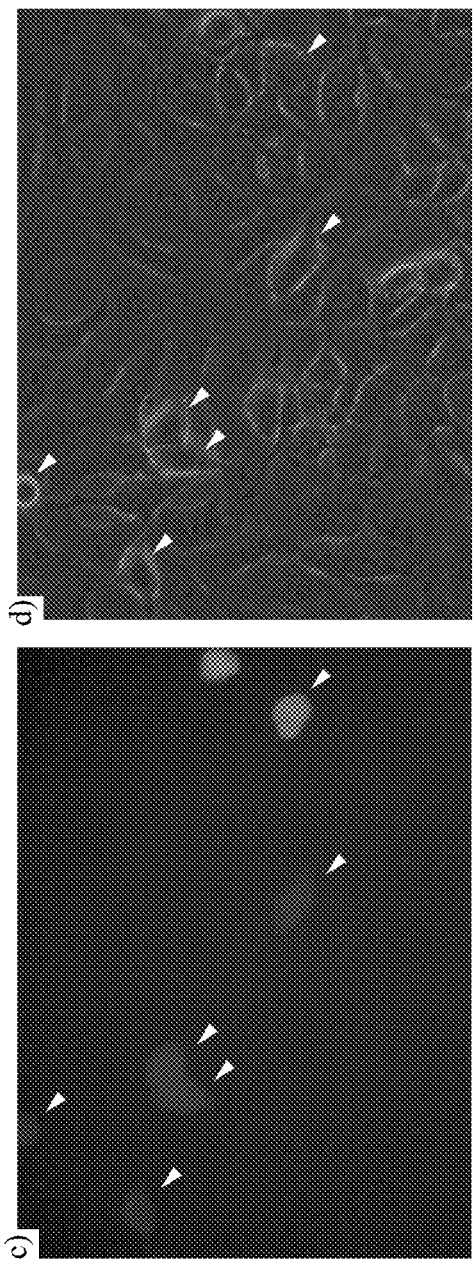
Fig. 13C
Fig. 13D

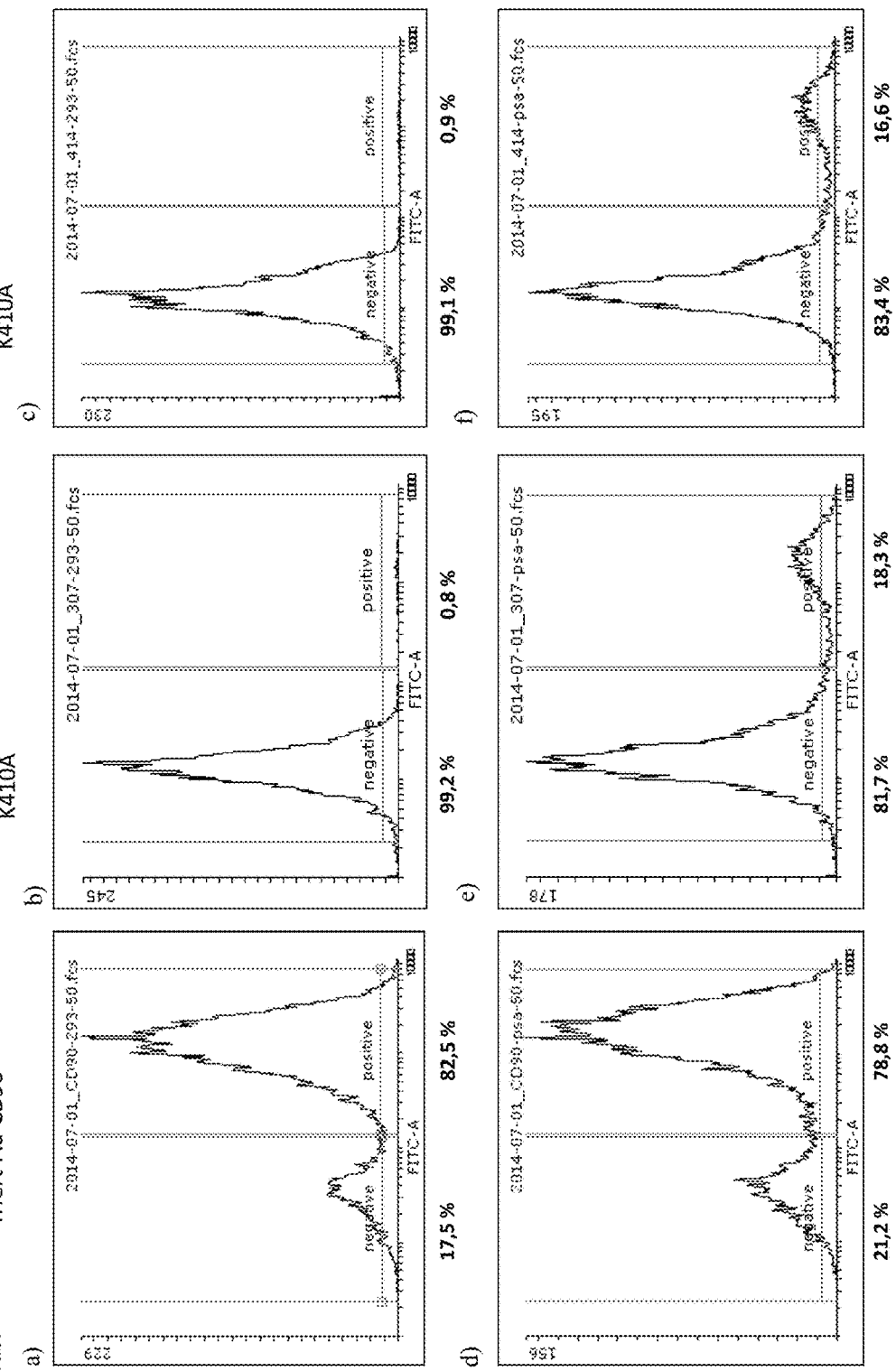

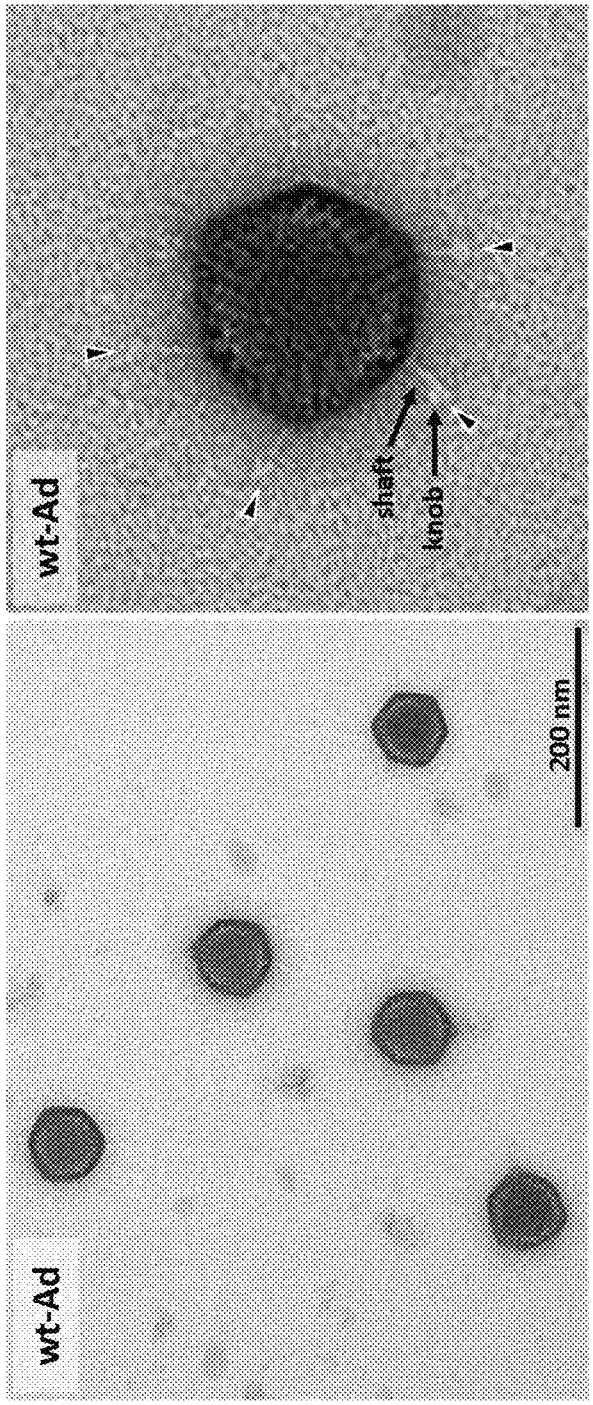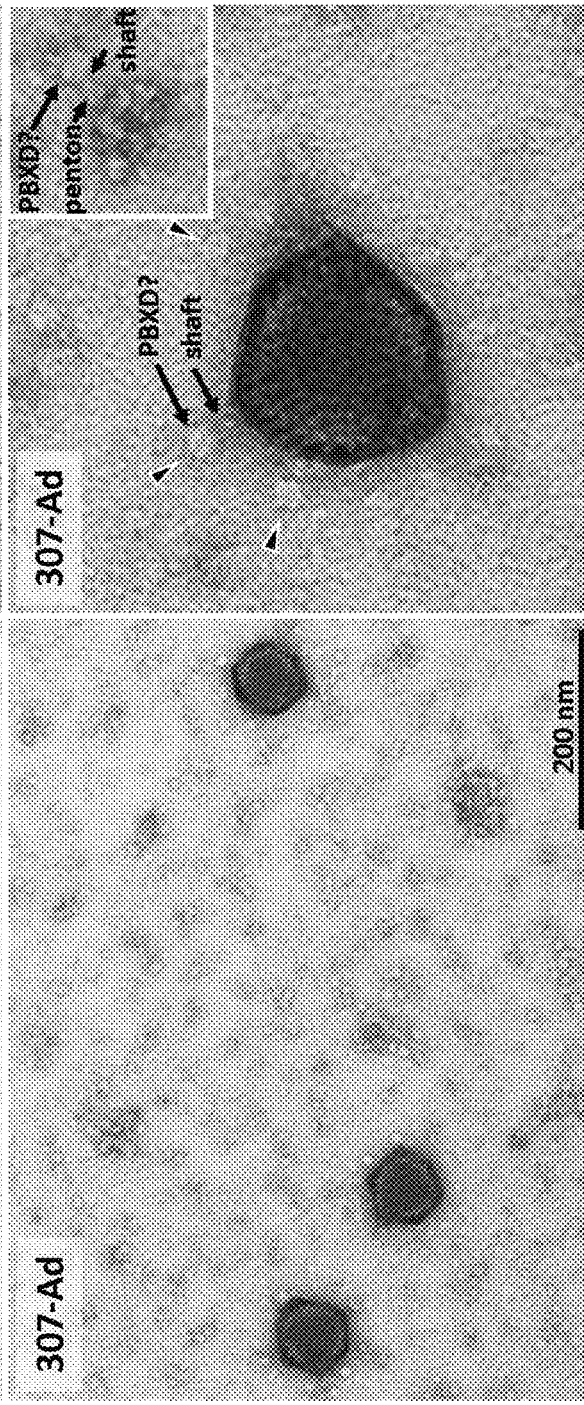

ANTI-TUMOR MEDICAMENT BASED ON ADENOVIRUS

The present invention provides manipulated adenovirus, especially a viral particle based on a manipulated adenovirus, for use as a medicament, especially for use in the treatment of tumours, including e.g. solid and cellular neoplasms. Further, the invention relates to the use of the viral particle in a process for manufacturing a medicament for the treatment of tumours and to a process for the treatment of tumours comprising the step of administering the viral particle. The viral particle of the invention has the advantage of having a preference or specificity for tumour cells, yielding a preferred infection of tumour cells e.g. in comparison to non-tumour cells.

The viral particle has the advantage of replicating within infected cells, thus reproducing the viral particle and allowing re-targeting of the viral particle to tumour cells.

In a further embodiment, the viral particle is devised to express a transgene contained in an expression cassette upon contact with the tumour cell. The transgene can be a therapeutically protein or nucleic acid molecule that is active against tumour cells.

STATE OF THE ART

Staba et al., Cancer Gene Therapy 13-19 (2000) describe that an alteration of the fiber-coat protein of a non-replicating adenoviral vector to contain a polylysin modification increased transfection efficiency in tumours in vivo.

Cripe et al., Cancer Research 2953-2960 (2001) describe that in rhabdomyosarcoma cells expressing the integrin internalisation receptor for adenovirus, low infectivity by adenovirus is caused by low expression of the cellular coxsackie-virus-adenovirus receptor (CAR). Modification of the fiber knob molecule of adenovirus that originally specifically binds to CAR by introducing an integrin-binding RGD peptide or a polylysine peptide into the fiber knob increased infection of the cells.

Glasgow et al., Cancer Gene Therapy 830-844 (2006) review targeting of adenovirus by addition of bispecific molecules binding to a cell surface molecule and to the CAR-binding knob of adenovirus. As an alternative, the fiber and knob domains of adenovirus are reported to be replaced by the trimerizing T4 fibritin and a C-terminal 6-His motif for specific binding to a 6-His receptor expressed on a cell, or replaced by trimeric CD40 ligand fused to the C-terminus of T4 fibritin.

Stummeyer et al., Molecular Microbiology 1123-1135 (2006) describe the bacteriophage K1F to encode an endosialidase adjacent the section encoding an N-terminal capsid binding part of gp17 protein, relevant for connection to capsid protein. The bacteriophage K1F is highly specific for infecting the virulent E. coli K1, known to have an $\alpha 2,8$-linked polysialic acid (polySia) capsule. The $\alpha 2,8$-linked polysialic acid is poorly immunogenic due to structural identity to polySia of the neural cell adhesion molecule (NCAM).

US 2011/0189234 A1 describes the production of an adenoviral particle lacking a functional fiber knob domain in the presence of the adenovirus E3 protein. For targeting the viral particle, it can be provided with a trimerization domain and a binding molecule, e.g. ligands for receptors, cytokines, TNF, growth factors, adhesion molecules, or carbonic anhydrase, amino acid sequences RGD or NGR known to bind to integrins or CD13.

WO2004/007537 A2 relates to adenoviral particles containing a fiber from which the binding domains for glycosaminoglycan and/or for sialic acid are mutated to reduce or abolish binding of the adenoviral particle to glycosaminoglycan and/or sialic acid as a receptor.

Kühnel et al., J. Virol. 13743-13754 (2004) describe protein transduction domain fusion proteins that enhance cellular virus uptake in anti-tumour treatment.

Kavoosi et al., Biotechnol. Bioeng. 599-610 (2007) describe a method for identifying linker peptides for specific fusion proteins expressed in E. coli.

Krasnykh et al., J. Virology 4176-4183 (2001) describe wild-type adenovirus to have a knob domain linked by a stem-like fiber protein domain to a penton base protein that forms part of the viral particle. The knob domain is at the C-terminus, while the N-terminus of the fiber domain attaches to the penton base protein. In the wild-type, the knob domain is generally seen as mediating cellular infection by binding to the coxsackievirus and adenovirus receptor (CAR), which is present on a large variety of healthy cells. The fiber domain is a trimer of three identical 62 kDa peptides, the trimerisation of which is assumed to be essential for structure and function of the virus. The knob domain initiates and maintains trimerisation of the entire fiber molecule. Modifications of the complex structure of the fiber knob domains may result in destabilisation of the trimer formation and hence in non-functional viral particles. Krasnykh describes a fiber domain from which the wild-type knob domain was deleted and replaced by a 6-His domain having specificity for an artificial cell surface receptor. For compensating the trimerisation activity of the wild-type knob domain towards the fiber domain, the tail and two N-terminal repeats of the wild-type shaft domain of the Ad5 fiber domain were genetically fused to a truncated bacteriophage T4 protein.

The entire fiber protein of adenovirus serotype 5 (Ad5), containing the fiber domain and the knob domain, is known, e.g. from Schagen et al., Hum Gene Ther. 783-794 (2008) to consist of an N-terminal tail domain, linking to the penton base protein, a flexible fiber domain, also designated as shaft, bordering on the C-terminus of the tail domain, and an adjacent C-terminal knob domain, which is responsible for binding to CAR. Schagen et al. describe the cloning of an adenoviral particle bearing the oligomerization domain of reovirus attachment protein $\sigma 1$, resulting in an altered host cell specificity.

Mercier et al., Proc Natl Acad Sci USA, 6188-6193 (2004) describe the cloning of a viral particle on the basis of Ad5 fiber protein that contains the $\sigma 1$ protein of reovirus type 3 Dearing for mucosa targeting.

Tsuruta et al., Clin Cancer Res. 2777-2783 (2007) and Schagen et al., Human Gene Therapy 783-794 (2008) describe a chimeric Ad5 fiber protein with $\sigma 1$ protein of reovirus, to the reovirus head domain of which a 6-His tag was added. Further, Tsuruta et al. describe a chimeric Ad5/Ad3 fiber.

OBJECT OF THE INVENTION

It is an object of the invention to provide an alternative viral particle on the basis of adenovirus which preferably infects tumour cells rather than non-neoplastic cells in humans and/or in animals and which particle can replicate within cells in order to allow a continuous activity of the viral particle against tumour cells without addition of an external agent mediating the specificity to tumour cells.

DESCRIPTION OF THE INVENTION

The invention achieves the object by the features of the claims, especially by a viral particle based on adenovirus, especially type C, preferably serotype 2 (Ad2), more preferably serotype 5 (Ad5), in which the native entire fiber protein, and its coding sequence, respectively, is deleted and replaced by a fusion protein, and its coding sequence, respectively. The fusion protein provides specificity for cell surface bound α2,8-linked N-acetylneuraminic acid, herein also termed polysialic acid or polySia, especially linear homopolymers of α2,8-linked N-acetylneuraminic acid. The fusion protein from N-terminus to C-terminus comprises or consists of an adenovirus tail domain, optionally at least one pseudo-repeat, optionally a linker, and an endosialidase of bacteriophage origin. In the viral particle, this fusion protein is encoded by the DNA contained in the viral particle. The viral particle containing this fusion protein therefore lacks the native knob domain of its fiber protein, which is replaced by an endosialidase of bacteriophage origin. For the purposes of the invention, the fusion peptide linked to the penton base protein and comprising the endosialidase is also referred to as polySia-binder.

Accordingly, the viral particle contains a polySia-binder comprising or consisting of, from N-terminus to C-terminus, one tail domain originating from adenoviral fiber protein, optionally at least one pseudo-repeat of a fiber domain, and one endosialidase of bacteriophage origin, with an optional linker peptide between the at least one pseudo-repeat of a fiber domain and the endosialidase, the polySia-binder being coupled to the penton base protein. Accordingly, the endosialidase of bacteriophage origin can be linked directly to the tail domain or to the optional linker peptide present at the C-terminus of the tail domain. Accordingly, the tail domain does not contain the bacteriophage knob domain. The DNA contained in the viral particle encodes the polySia-binder, in which DNA the coding sequence for fiber protein is inactivated, e.g. deleted, the DNA encoding the polySia binder preferably replacing the DNA sequence encoding the fiber protein.

For example, the viral particle is based on adenovirus C serotype 5 (Ad5), having a genomic sequence accessible at GenBank at accession No. AY339865.1, in which the coding sequence of nucleotides 31037 to 32782 encodes the natural fiber protein, which coding sequence according the invention is inactivated, preferably deleted, and in its place a coding sequence for the fusion protein, the polySia binder, is arranged.

Optionally, in the viral particle, the coding sequence for the early protein E3 is inactivated, e.g. deleted. A deletion of the coding sequence for protein E3 can e.g. comprise or consist of a deletion of nucleotides encoding E3, e.g. nucleotides No. 28132 to 30814, encompassing a deletion of approx. 2.7 kbp in the sequence accessible at GenBank at accession No. AY339865.1.

For the viral particle, the bacteriophage endosialidase has been found to selectively bind to polysialic acid present on the cell surface of some mammalian cells and to allow infection by the viral particle of mammalian cells bearing polysialic acid, whereas infection of cells having essentially no surface-bound polysialic acid were not infected to a detectable level. In these analyses cell lines were used that bear the natural receptor CAR for native adenovirus with only one cell line bearing polysialic acid on its surface. The results show that the viral particle of the invention, bearing on its penton base protein the fusion protein containing at its C-terminus an endosialidase of bacteriophage origin that replaces the native knob domain, with preference, preferably with predominance, infects mammalian cells and tissue bearing cell-surface bound polysialic acid in comparison to cells essentially lacking cell-surface bound polysialic acid. Optionally, the endosialidase can be mutated to diminish or inactivate its enzymatic activity, as it has been found that such mutations still allow binding of the polySia-binder to cell surface bound polysialic acid. Generally preferred, the endosialidase of the polySia binder preferably is an endosialidase of bacteriophage origin which at its the N-terminus is truncated to delete its bacteriophage attachment domain, and accordingly, the endosialidase lacking the bacteriophage attachment domain of the polySia binder can also be referred to as an endosialidase domain.

Accordingly, it is preferred that the viral particle is for use in the treatment of tumours, wherein the tumour cells bear cell-surface bound polysialic acid, e.g. the tumour is selected from glioblastoma, medulloblastoma, rhabdomyosarcoma, small cell carcinoma, e.g. small cell lung carcinoma.

In the fusion protein, the tail domain can e.g. be selected from the sequences comprising or consisting of the C-terminal tail domain of adenovirus, e.g. adenovirus serotype 2, preferably adenovirus serotype 5.

In the fusion protein, the optional pseudo-repeats arranged at the N-terminus of the tail domain can comprise or consist of at least one to at least 22 or more pseudo-repeats, e.g. their number can be lower, higher or equal to the number of pseudo-repeats in the natural fiber protein, and preferably is reduced in comparison to the number of pseudo-repeats in the natural fiber protein, e.g. be shortened to contain at least one pseudo-repeat, e.g. to contain one to 22, e.g. to contain 8 to 19 pseudo-repeats.

The invention is described with reference to the following exemplary sequences: SEQ ID NO: 1 (ΔC521-Fiber-PT8P-ΔN247-Endo-K1F) encodes a polySia-binder, in which the N-terminal adenovirus tail domain is the wild-type tail domain, the pseudo-repeat section contains one pseudo-repeat, obtained by truncation of the 521 amino acids from the C-terminus of the wild-type fiber protein, a linker $((PT)_8P)$ at amino acids 45 to 65, and the N-terminally truncated endosialidase from bacteriophage K1F, obtained by N-terminal truncation by 247 amino acids from the wild-type endosialidase.

SEQ ID NO: 2 (ΔC414-Fiber-PT8P-ΔN247-Endo-K1F) encodes a polySia-binder, in which the N-terminal adenovirus tail domain is the wild-type tail domain, the pseudo-repeat section contains 8 pseudo-repeats, obtained by truncation of the 414 amino acids from the C-terminus of the wild-type fiber protein, a linker $((PT)_8P)$, and the N-terminally truncated endosialidase from bacteriophage K1F, obtained by N-terminal truncation by 247 amino acids. SEQ ID NO: 3 (ΔC307-Fiber-PT8P-ΔN247-Endo-K1F) encodes a polySia-binder, in which the N-terminal adenovirus tail domain is the wild-type tail domain, the pseudo-repeat section contains 14 pseudo-repeats, obtained by truncation of the 307 amino acids from the C-terminus of the wild-type fiber protein, a linker $((PT)_8P)$ containing 8 repetitions of amino acids PT, and the N-terminally truncated endosialidase from bacteriophage K1F, obtained by N-terminal truncation by 247 amino acids.

Generally, at least one amino acid, e.g. 1 to 3 amino acids, e.g. proline, glycine and/or serine, can be comprised in the linker in addition to the repetitions at the C-terminus and/or at the N-terminus of the linker. In the exemplary embodiments, ProGly is present at the N-terminus of the repetitions (PT)$_8$P, and a Ser is present at the C-terminus of the repetitions (PT)$_8$P. In general, the polySia binder can contain essentially any linker between the C-terminus of the tail domain or of the pseudo-repeat of the fiber domain and the N-terminus of the endosialidase.

SEQ ID NO: 4 (ΔC235-Fiber-PT8P-ΔN247-Endo-K1F) encodes a polySia-binder, in which the N-terminal adenovirus tail domain is the wild-type tail domain, the pseudo-repeat section contains 14 pseudo-repeats, obtained by truncation of the 235 amino acids from the C-terminus of the wild-type fiber protein, a linker ((PT)$_8$P), and the N-terminally truncated endosialidase from bacteriophage K1F, obtained by N-terminal truncation by 247 amino acids.

The at least one pseudo-repeat can e.g. be selected from the sequences comprising or consisting of amino acids No. 45 to 60 of SEQ ID NO: 1, containing 1 pseudo-repeat, amino acids No. 45 to 168 of SEQ ID NO: 2, containing 8 pseudo-repeats, amino acids No. 45 to 274 of SEQ ID NO: 3, containing 15 pseudo-repeats, and amino acids No. 45 to 348 of SEQ ID NO: 4, containing 19 pseudo-repeats.

The optional linker peptide can e.g. have 10 to 30 amino acids, e.g. 15 to 20 amino acids, e.g. be selected from the sequences comprising or consisting of the (PT)$_8$P linker (8 repeats of Pro-Thr, and a Pro, including N-terminal GlyPro and C-terminal Ser) of amino acids No. 349 to 368 of SEQ ID NO: 4.

The endosialidase of bacteriophage origin is truncated at its N-terminus to delete its natural attachment domain that mediates binding of the endosialidase catalytic portion to the bacteriophage capsid. As a result, the endosialidase domain of the polySia-binder is devoid of this N-terminal attachment domain.

Preferably, the endosialidase is selected from the group comprising or consisting of the endosialidase of bacteriophage K1E, the endosialidase of bacteriophage K1F, endosialidase of bacteriophage NK1 (CUS3), and endosialidase of bacteriophage φ92. The amino acid sequence of endosialidase domain without its respective N-terminal attachment domain of the endosialidase of bacteriophage K1E is given as SEQ ID NO: 5, in which the native N-terminal 40 amino acids are deleted, of the endosialidase of bacteriophage K1F is given as SEQ ID NO: 6, in which the native N-terminal 247 amino acids are deleted, the endosialidase of bacteriophage NK1 (CUS3) is given as SEQ ID NO: 7 in which the native N-terminal 147 amino acids are deleted, and the endosialidase of bacteriophage φ92 is given as SEQ ID NO: 8 in which the native N-terminal 76 amino acids are deleted.

Preferably, the polySia-binder from N-terminus to C-terminus comprises or consists of
  the tail domain selected from the group of amino acids No. 1 to 44 of SEQ ID NO: 4
  optionally at least 1 pseudo-repeat, e.g. up to 32 pseudo-repeats, e.g. 1 to 22 pseudo-repeats, each pseudo-repeat of SEQ ID NO: 12, e.g. 22 pseudo-repeats of amino acids No. 45 to 391 of SEQ ID NO: 4,
  optionally a linker peptide, e.g. selected from the group comprising (PT)$_X$P, wherein X is 1 to 10, e.g. (PT)$_8$P (SEQ ID NO: 15) wherein X is 8, and S$_3$N$_{10}$ (SEQ ID NO: 17),
  an endosialidase of bacteriophage origin, lacking its bacteriophage attachment domain, e.g. selected from SEQ ID NO: 5 (EndoK1E), SEQ ID NO: 6 (EndoK1F), SEQ ID NO: 7 (EndoNK1), and SEQ ID NO: 8 (Endoφ92). From these, a C-terminal chaperone domain is removed during propagation of the viral particle in a host cell, e.g. auto-catalytically or catalytically by an adenoviral or host cell protein. The endosialidase can have a mutation, resulting e.g. in an amino acid deletion or substitution, for example in SEQ ID NO: 5 (EndoK1E), the mutation of the sequence of which is given as SEQ ID NO: 41 (EndoK1E-K200A), in SEQ ID NO: 42 (EndoK1E-R386A/R437A), in SEQ ID NO: 6 (EndoK1F), the mutation of the sequence of which is given as SEQ ID NO: 9 (EndoK1F-K410A), in SEQ ID NO: 10 (EndoK1F-R596A/R647A), in SEQ ID NO: 7 (EndoNK1) the mutation of the sequence of which is given as SEQ ID NO: 43 (EndoNK1-R503A/R554A), in SEQ ID NO: 8 (EndoPhi92), the mutation the sequence of which is given as SEQ ID NO: 44 (EndoPhi92R436A/R437A).

The mutant sequences have a reduced or completely abolished enzymatic activity and have similar to identical binding properties in comparison to the non-mutant sequences. For example, EndoK1F-K410A has an enzymatic activity of approx. 20% of the wild-type but essentially the same affinity and specificity for polysialic acid, EndoK1F R596A/R647A has no detectable enzymatic activity while maintaining essentially the same affinity and specificity for polysialic acid. Accordingly, for the purposes of the invention, the endosialidase of the fusion protein can optionally have a reduced enzymatic activity on polysialic acid or be devoid of enzymatic activity on polysialic acid, preferably having the affinity and specificity for polysialic acid as a non-mutant wild-type endosialidase of bacteriophage origin. The enzymatic activity on polysialic acid can be reduced, e.g. to a degree that the endosialidase is devoid of enzymatic activity on polysialic acid, due to a mutation, e.g. a mutation of a catalytically active amino acid, e.g. a mutation resulting in the replacement of a catalytically active amino acid by another amino acid.

In SEQ ID NO: 5 (EndoK1E), SEQ ID NO: 6 (EndoK1F), SEQ ID NO: 7 (EndoNK1), and SEQ ID NO: 8 (Endoφ92) the N-terminal bacteriophage attachment domain is removed, which e.g. in EndoK1F comprised amino acids 1 to 246 of the wild-type bacteriophage protein.

Exemplary fusion proteins have an amino acid sequence of at least 90%, preferably at least 95%, more preferred at least 98% identity to one of SEQ ID NO: 1, SEQ ID NO: 2, SEQ ID NO: 3 or SEQ ID NO: 4. The sequence alignment of FIG. 6 shows that the endosialidases of bacteriophage origin, preferably without their C-terminal attachment domains, have an identity of at least 51 to at least 76%. Accordingly, the endosialidase of the polySia-binder preferably has an amino acid identity of at least 51%, preferably of at least 76%, more preferably of at least 90% or at least 95% to one or more of these endosialidases of bacteriophage origin. In the alternative or in addition to the amino acid identity, the endosialidase of the polySia-binder preferably has a very high homology to one or more of these endosialidases of bacteriophage origin or has a conserved primary structure respectively.

Preferably, the nucleic acid sequence encoding the viral particle, especially the nucleic acid sequence encoding the polySia binder, have the codon usage of the tumour cell, preferably the human codon usage for the viral particle for use as a medicament in a human patient.

The nucleic acid sequence encoding the viral particle of the invention comprises the nucleic acid sequence, e.g. DNA, which encodes the polySia binder. Accordingly, the viral particle in its DNA contains the sequence which encodes the polySia binder.

For example, the sequence encoding the polySia binder from 5' to 3' comprises or consists of the coding sequence for the polySia binder fusion protein, e.g.
- one tail domain, e.g. selected from the group of SEQ ID NO: 11, encoding SEQ ID NO: 12,
- optionally the coding sequence for at least one pseudo-repeat, e.g. selected from the pseudo-repeats of SEQ ID NO: 13, encoding SEQ ID NO: 14,
- optionally the coding sequence for a linker peptide, e.g. selected from the repetitive element of SEQ ID NO: 15 encoding SEQ ID NO: 16, and SEQ ID NO: 17 encoding SEQ ID NO: 18,
- the coding sequence for an endosialidase selected from the group of SEQ ID NO: 19, ΔN247-Endo-K1F which encodes the endosialidase of bacteriophage K1F from which the section encoding the N-terminal 247 amino acids are deleted, encoding SEQ ID NO: 20, SEQ ID NO: 21 encoding SEQ ID NO: 22 ΔN40-Endo-K1E which encodes the endosialidase of bacteriophage K1E from which the section encoding the N-terminal 40 amino acids are deleted, SEQ ID NO: 23 ΔN147-Endo-NK1 (CUS3) which encodes the endosialidase of bacteriophage φ92 from which the section encoding the N-terminal 147 amino acids are deleted, encoding SEQ ID NO 24, SEQ ID NO: 25 ΔN76-Endoφ92 which encodes the endosialidase of bacteriophage φ92 from which the section encoding the N-terminal 76 amino acids are deleted, encoding SEQ ID NO: 26, wherein each coding sequence for the endosialidase of bacteriophage origin lacks the region encoding an attachment domain mediating attachment of the bacteriophage endosialidase to the bacteriophage capsid. The nucleotide sequences comprise the coding sequence for the C-terminal chaperone domain for those endosialidases containing a C-terminal chaperone and have the human codon usage.

The coding sequence for proteins that determine the onset of viral replication in the target cell (E1A) can be contained in the DNA of the viral particle in functional arrangement under the control of a polsialyltransferase promoter, e.g. of mammalian origin, preferably of human origin, or promoters involved in control of cell cycle progression or immortalization, preferably under the control of a telomerase promoter. An exemplary telomerase promoter, which is contained at nucleotides No. 343 to 597 at accession number AY339865.1 at GenBank is given as SEQ ID NO: 27, exemplary polysialyltransferase promoters as SEQ ID NO: 28 (ST8SiaII-promoter region) and SEQ ID NO: 29 (ST8SiaIV promoter region). The arrangement of essential replication proteins such as E1A under control of the aforementioned promoters has the advantage that the onset of viral replication is only permitted in tumour cells (e.g. if a telomerase promoter is used), or, preferably in tumour cells that express essential enzymes required for production of polysialic acid (e.g. if a polysialyltransferase promoter is used). This embodiment is preferred as it preferably allows that viral entry mechanism and virus replication are synchronized to the same molecular target.

The linker peptide is arranged N-terminally to the endosialidase, e.g. adjacent the C-terminus of the tail domain or of the at least one pseudo-repeat, and adjacent the N-terminus of the endosialidase.

Optionally, the viral particle contains an expression cassette for a transgene under the control of a promoter, which promoter is a telomerase promoter, e.g. having a sequence given as SEQ ID NO: 27, or which promoter is an endosialidase promoter, e.g. selected from SEQ ID NO: 28 (ST8SiaII) and SEQ ID NO: 29 (ST8SiaIV). The arrangement of a transgene under functional control of a telomerase promoter or of an endosialidase promoter has the advantage of expression of the transgene when the expression cassette is located within a tumour cell.

Figure 7:
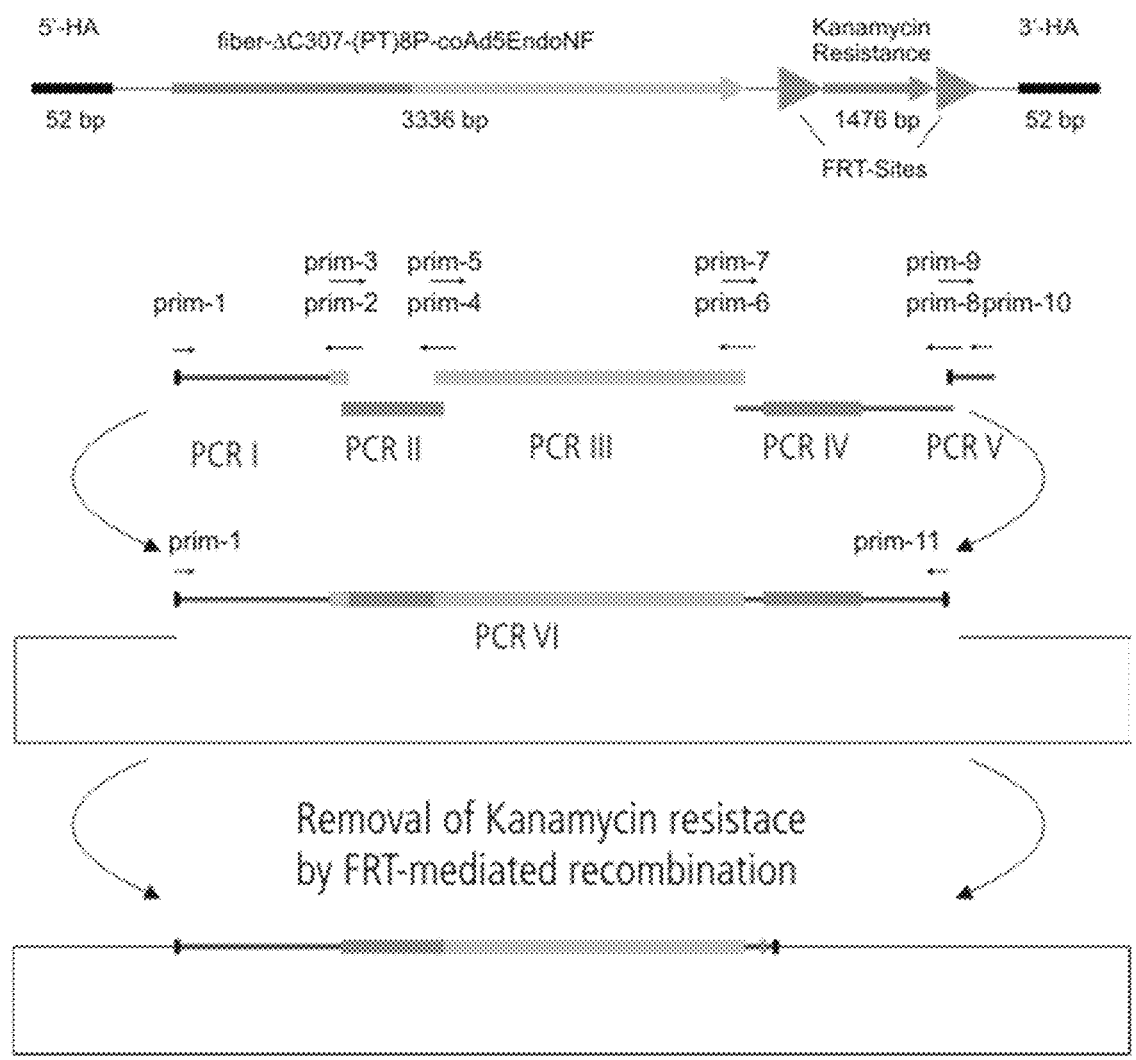
Figure 16:
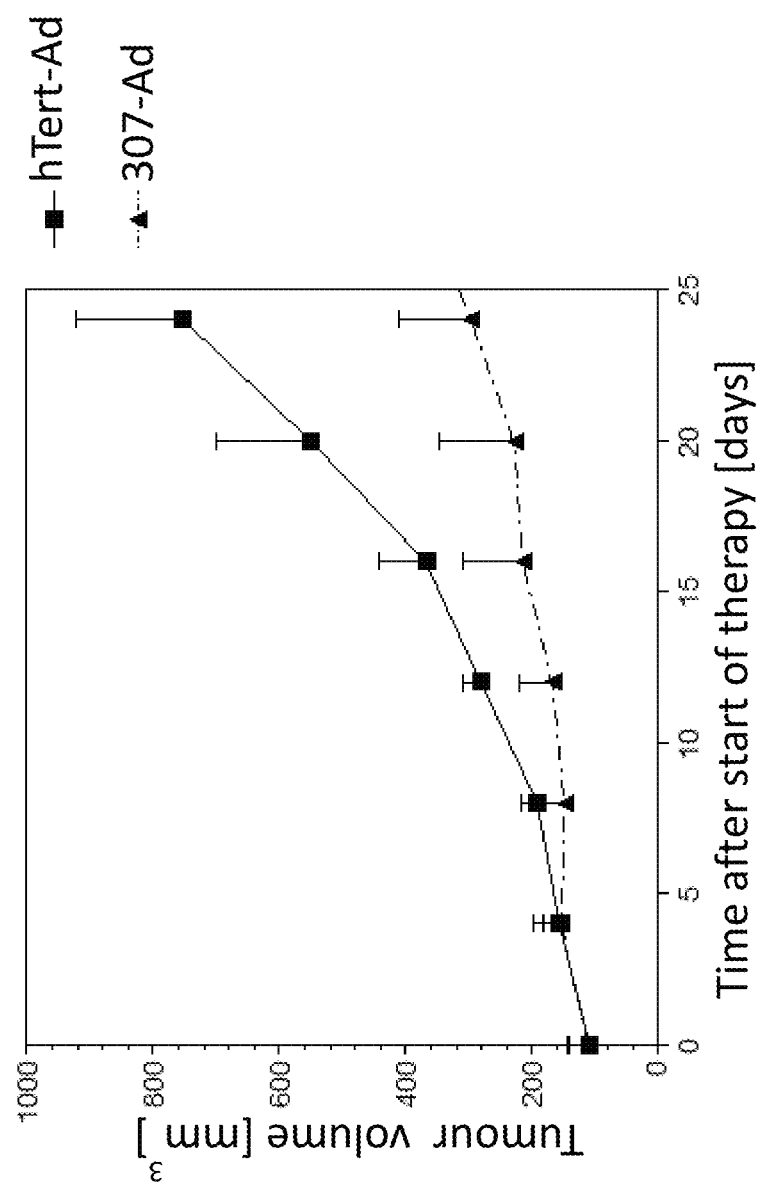

The invention will now be described in greater detail by way of examples with reference to the figures, which show in FIG. 1 a scheme of the domains of the wild-type adenovirus serotype 5 fiber protein, FIG. 2 a scheme of an embodiment of the fusion protein having 1 pseudo-repeat, FIG. 3 a scheme of an embodiment of the fusion protein having 8 pseudo-repeats, FIG. 4 a scheme of an embodiment of the fusion protein having 14 pseudo-repeats, FIG. 5 a scheme of an embodiment of the fusion protein having 18 pseudo-repeats, FIG. 6 an amino acid sequence alignment of preferred endosialidase domains, FIG. 7 a scheme for cloning the coding sequence for fusion protein to replace the natural fiber protein in adenovirus, FIG. 8 a Western blot specific for the fusion protein of the invention on cell culture samples infected by viral particles of the invention, FIG. 9 a graph on the titer of viral particles of the invention in different cell lines, FIGS. 10A-10D micrographs of a cell line not expressing polysialic acid in the presence of an embodiment of the viral particle of the invention, FIGS. 11A-11D micrographs of a cell line expressing polysialic acid in the presence of the embodiment of the viral particle of FIG. 10a) to d), FIGS. 12A-12D micrographs of a cell line not expressing polysialic acid in the presence of an embodiment of the viral particle of the invention, FIGS. 13A-13D micrographs of a cell line expressing polysialic acid in the presence of the embodiment of the viral particle of FIG. 12a) to d), FIGS. 14A-14F FACS results from different cell line cultures infected by viral particles of the invention, FIGS. 15A-15B electron micrographs of wild-type adenovirus and at c) and d) electron micrographs of a viral particle of the invention, and FIG. 16 shows an amino acid sequence comparison of preferred endosialidase domains of the fusion protein.

FIG. 17 describes the effect of wild-type oncolytic adenovirus compared with a virus expressing polySia-binding fusion protein (307-Ad) on human tumour growth when applied to transplanted tumours on nude mice.

FIG. 1 for comparison shows a scheme of the domains of the wild-type fiber protein of adenovirus serotype 5, from N-terminus to C-terminus consisting of a tail domain of 44 amino acids (aa) that binds to the penton base, 22 pseudo-repeats at amino acids 45 to 407, and the knob domain at amino acids 408 to 581 that binds to CAR.

Figure 2:
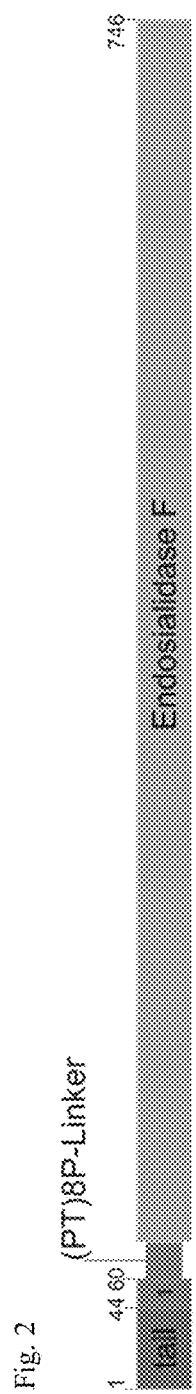
Figure 3:
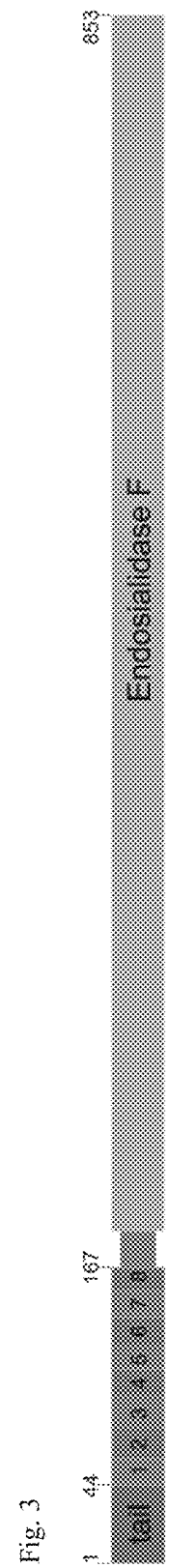
Figure 4:
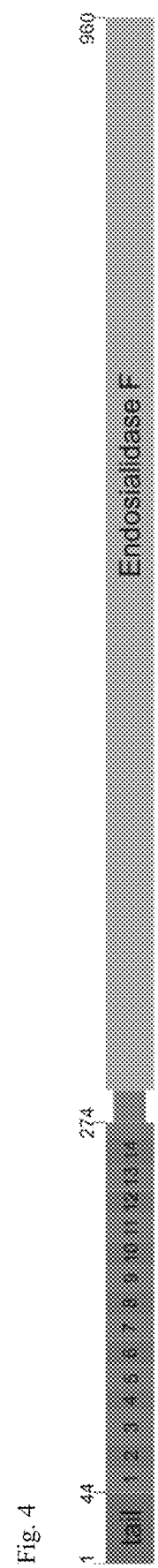
Figure 5:

FIGS. 2 to 5 depict embodiments of the polySia-binder, which from N-terminus to C-terminus consist of the penton base binding tail domain (tail) that is represented by the wild-type tail domain of 44 aa, directly adjacent at least 1 pseudo-repeat, namely in FIG. 2 a polySia-binder containing 1 pseudo-repeat (designated ΔC521), in FIG. 3 a polySia-binder containing 8 pseudo-repeats (designated ΔC414), in FIG. 4 a polySia-binder containing 14 pseudo-repeats (designated ΔC307), and in FIG. 5 a polySia-binder containing 19 pseudo-repeats (designated ΔC235), in each embodiment directly adjacent a linker, which is represented by the (PT)₈P linker (SEQ ID NO: 16), directly adjacent the endosialidase, which is represented by the endosialidase of bacteriophage K1F, in the K410A mutant form, in the wild-type form (Endosialidase NF K410A/wt) or in a completely inactive double mutant form (Endosialidase NF R596A/R647A).

The designations of these exemplary embodiments indicate the deletions that were made, counting from the C-terminus of the wild-type fiber protein. Optionally all embodiments (ΔC235, ΔC307, ΔC414 and ΔC521) contained the mutation K410A which resulted in a reduced endosialidase activity and did essentially not affect binding to cell surface bound polysialic acid. All of the aforementioned embodiments can optionally contain the double mutation R596A/R647A, abolishing the endosialidase activity but not affecting the binding to polysialic acid. Generally, a deletion can be indicated by a Δ, D, d, or delta, with the letter N indicating a deletion from the N-terminus, the letter C indicating a deletion from the C-terminus.

The N-terminal section of 247 amino acids of the wild-type form is not contained in the polySia-binder in order to delete the wild-type bacteriophage attachment domain.

In the examples, in all viral genomes of the invention and in the wild-type adenovirus used, the coding sequence for E3 protein was deleted.

Exemplary DNA sequences in the form of a bacterial plasmid for cloning a viral particle containing the polySia-binder of the invention are shown in SEQ ID NO: 45, SEQ ID NO: 49 and SEQ ID NO: 51. Therein, the endosialidase is represented by EndoK1F (endoNF), and the expression cassette is under the control of the endosialidase promoter (SEQ ID NO: 45 and 49) or a telomerase promoter (SEQ ID NO: 51), respectively. In SEQ ID NO: 45, nucleotides 28582 to 32136 encode the polySia binder, SEQ ID NO: 48 shows the amino acid sequence of the polySia binder. The N-terminally truncated E3 14.7K encoded by SEQ ID NO: 45 is given as SEQ ID NO: 47, SEQ ID NO: 46 shows the amino acid sequence of the C-terminally truncated E3 14.5K encoded by SEQ ID NO: 45. In SEQ ID NO: 49, nucleotides 29611 to 33165 encode the polySia binder, its amino acid sequence is given as SEQ ID NO: 50. In SEQ ID NO: 51, nucleotides 28447 to 32001 encode the polySia binder, its amino acid sequence is given as SEQ ID NO: 52.

Exemplary complete virus genomes containing a coding sequence for the polySia binder of the invention are given as hTert-Ad-ΔC235fiber-(PT8)P-ΔN247EndoNF-K410A (SEQ ID NO: 53), wherein nucleotides 28447 to 32001 encode the polySia binder, its amino acid sequence is given as SEQ ID NO: 57. SEQ ID NO: 54 to SEQ ID NO: 56 and SEQ ID NO: 58 give the further amino acid sequences of the codons indicated in SEQ ID NO: 53. A complete virus genome containing a coding sequence for the polySia binder termed hTert-Ad-ΔC307fiber-(PT8)P-ΔN247EndoNF-K410A is shown at SEQ ID NO: 59 (hTERT-Ad5_fiberEndo), encoding the polySia binder at nucleotides 28447 to 31782 (Fiber-Endo), the amino acid sequence of which is given as SEQ ID NO: 63. SEQ ID NO: 60 to 62 give the amino acid sequences of the codons indicated in SEQ ID NO: 59 A complete virus genome termed hTert-Ad-ΔC414fiber-(PT8)P-ΔN247EndoNF-K410A is given at SEQ ID NO: 64, encoding the polySia binder at nucleotides 28447 to 31464 (ΔC414fiber-(PT8)P-ΔN247EndoNF-K410A), the amino acid sequence is given at SEQ ID NO: 68. SEQ ID NO: 65 to 67 give further amino acid sequences of the codons indicated in SEQ ID NO: 64. These viral genomes contain DNA sections which form homologous arms for integration of the virus genome into the genome of the target cell by homologous recombination and encode the endosialidase of EndoNF as an embodiment of the endosialidase of phage origin without its phage attachment domain.

FIG. 6 shows the amino acid sequence alignment (Clustal Omega 1.2.1, available from EMBL-EBI) of the preferred endosialidases ΔN76-Endoϕ92 (EndoPhi 92-dN76, SEQ ID NO: 8), ΔN147-Endo-NK1(CUS3) (EndoNK1 dN147, SEQ ID NO: 7), ΔN247-Endo-K1F (EndoK1F-dN247, SEQ ID NO: 6), and ΔN40-Endo-K1E (EndoK1E-dN40, SEQ ID NO: 5) of the polySia-binder. In the alignment, * denotes an identical amino acid, "." and ":" denote amino acids having homology. The alignment shows that these endosialidases of bacteriophage origin have an amino acid identity of at least 51%.

Example 1: Cloning of DNA Encoding an Adenovirus Containing the PolySia-binder Generally, the DNA encoding the adenoviral particles are available by replacing the coding sequence for the fiber protein from the genome encoding a wild-type adenovirus by a sequence encoding the polySia-binder.

FIG. 7 schematically shows the cloning procedure for deleting the coding sequence for the wild-type fiber protein, contained in a bacterial vector containing the entire adenovirus serotype 5 genome, optionally lacking the coding sequence for E3 protein, by homologous recombination with a linear chloramphenicol resistance cassette (Chloramphenicol resistance), containing restriction sites (SpeI) flanked at both ends with sections homologous (homologous arms 5'-HA, 56 bp (base pairs) and 3'-HA, 52 bp) to the wild-type sequence. A subsequent digest with the specific restriction enzyme (SpeI) removed the chloramphenicol resistance cassette and linearized the plasmid for subsequent homologous recombination.

The coding sequence for the fusion protein was produced by PCR amplification of sections with primers having overlapping terminal sections, followed by a one-step fusion PCR (Szewczyk et al., Nature Protocols 2006, 3111-3120 and Erratum). The outermost primers of the fusion product contained homologous sections, and the fusion product was integrated into the previously prepared vector lacking the wild-type fiber encoding sequence using the Red/ET mediated recombination (available from Genebridges, USA). The primers used are indicated in FIG. 7, for PCRI (and PCR VI) prim-1 (SEQ ID NO: 30) and prim-2 (SEQ ID NO: 31), for PCRII prim-3 (SEQ ID NO: 32) and prim-4 (SEQ ID NO: 33), for PCRIII prim-5 (SEQ ID NO: 34) and prim-6 (SEQ ID NO: 35), for PCRIV prim-7 (SEQ ID NO: 36) and prim-8 (SEQ ID NO: 37), for PCRV prim-9 (SEQ ID NO: 38) and prim-10 (SEQ ID NO: 39) and for PCRVI prim-1 (SEQ ID NO: 40) and prim-11 (SEQ ID NO: 39).

The kanamycin resistance cassette was removed using its FRT sites by FLP/FRT recombination.

The plasmid containing the entire genome for the recombinant adenovirus having the polySia-linker in the place of the wild-type fiber protein was linearized by PacI and transfected into HEK293 cells for producing the adenovirus having the polySia binder, which construct is also referred to as Ad-polySia-binder herein. Ad-polySia-binder adenoviral particles were shown to contain the DNA encoding the genome having the polySia binder, both for the genome encoding all adenoviral proteins except the wild-type fiber protein, and for the embodiment, in which genome in addition the coding sequence for E3 was deleted.

In addition, the coding sequence contained an expression cassette for enhanced green fluorescent protein (EGFP) as a reporter, the coding sequence of which was functionally arranged under the control of the E1B promoter. The CDS (codons) of EGFP was linked to the CDS of E1B via an IRES motif.

Figure 8:
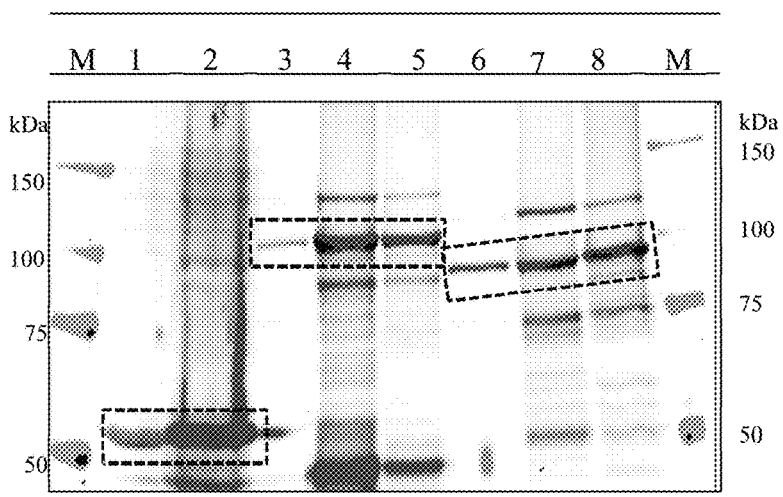

FIG. 8 shows a Western blot analysis of culture supernatant and cell lysate of HEK293 cells infected with the DNA encoding Ad-polySia-binder using a primary antibody (Abcam Anti-Adenovirus Fiber monomer and trimer antibody [4D2] (ab3233)) directed against the pseudo-repeats. Lanes M show size marker proteins, lanes 1 contains the soluble fraction of lysate 72 h post infection (p.i.) and lane 2 contains the insoluble fraction of lysate 72 h p.i. of the wild-type Adenovirus 5 showing the fiber protein at 62 kDa (box) as a positive control, lane 3 contains culture medium 72 h p.i. lane 4 contains the soluble fraction of lysate 72 h p.i., lane 5 contains the insoluble fraction of lysate 72 h p.i. of the construct ΔC307 showing the polySia-binder at 104 kDa (box) and 122 kDa, lane 6 contains culture medium 72 h post infection (p.i.) and lane 7 contains the soluble fraction of lysate 72 h p.i., lane 8 contains the insoluble fraction of lysate 72 h p.i. of the construct of ΔC414 showing the polySia-binder at 93 kDa (box) and 111 kDa. The detection of the polySia-binder protein at two sizes corresponds to the result of the removal of the C-terminal chaperone domain from the endosialidase domain.

Example 2: Producing Adenovirus Containing the PolySia-binder

For producing Ad-polySia binder viral particles, HEK293-polySia+ cells were cultivated in 60 T-75 culture flasks under cell culture conditions in Gibco® DMEMGlutaMAX, containing 2% v/v FCS, Penicillin (100 U/mL) and Streptomycin (100 μg/mL). Cells were grown to about 90% confluency and then infected with the ΔC307 construct with an MOI of 5. The infected cells were incubated until a strong cytopathic effect was observable and nearly all cells were detached. Cells were then collected by centrifugation and lysed by three repetitions of freezing and thawing. Subsequently, particles were concentrated by CsCl gradient centrifugation (96,000×g, 4 h), yielding $5.94 \times 10^{10}$ ifu (infectious particles)/mL in a total volume of 2 mL. The proportion of infectious particles in total particles was 1.25%.

These Ad-polySia binder viral particles were used to infect cell line cultures of HEK293 cells and of HEK293 cells that were genetically manipulated to express cell-surface bound polysialic acid (HEK293-polySia+) which in the example represented tumour cells bearing polysialic acid on their cell surface. HEK293-polySia+ were generated by retroviral transduction of HEK293 cells with a DNA encoding for the murine ST8SiaIV under the control of the CMV promoter.

Figure 9:
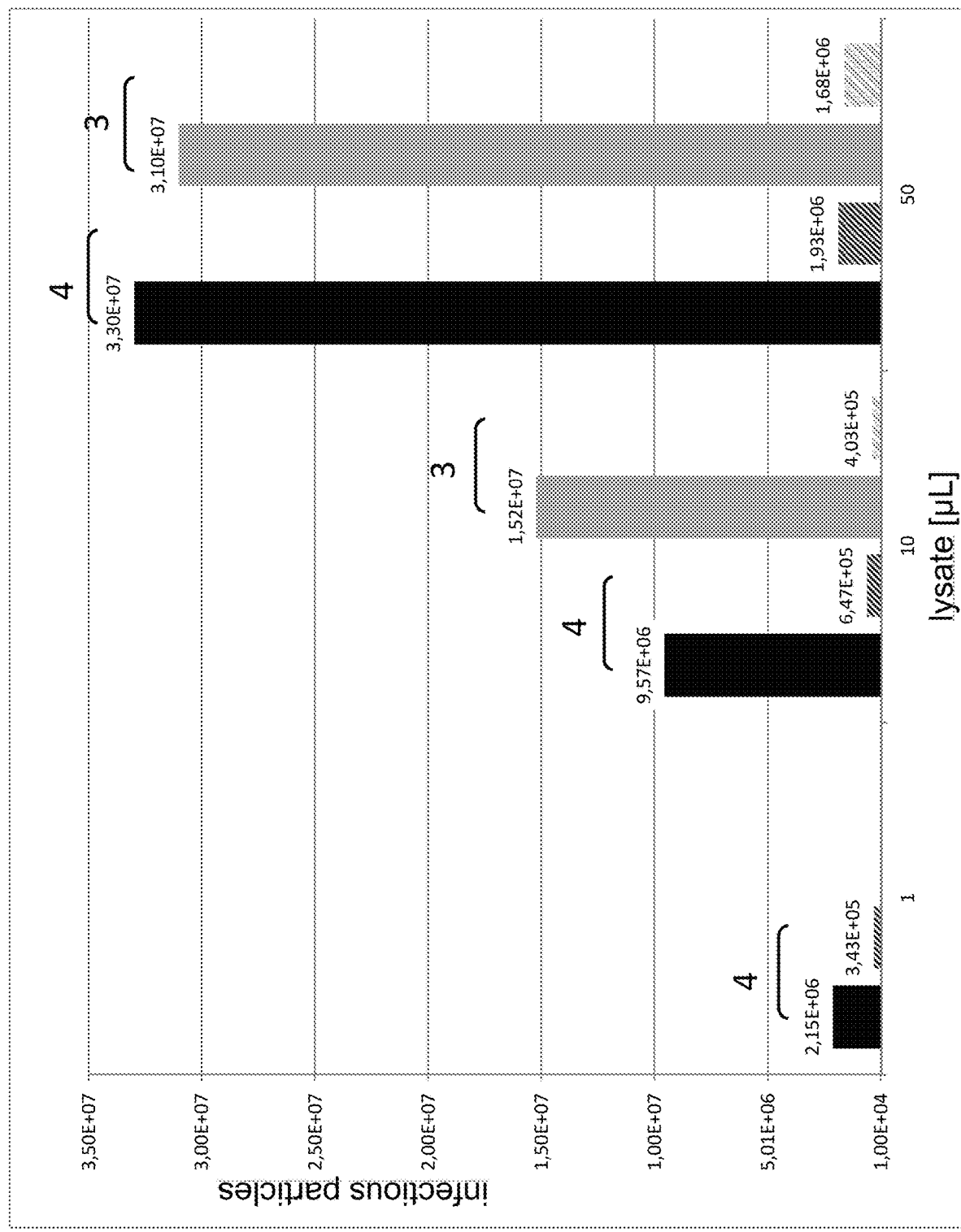

The results are depicted in FIG. 9, showing that HEK293 cells (hatched bars) were infected only to a very small extent, whereas HEK293 cells expressing cell-surface bound polysialic acid (HEK293-polySia+, dark bars) were infected to a significantly higher extent. In FIG. 8, the X-axis gives the volume in μL of $10^6$ ifu/mL added to each cell culture, the Y-axis gives the amount of infectious particles produced after isolated from $3 \times 10^5$ cells that were counted at the time of infection from the cell culture at 48 h post infection. Infection was for 30 min with subsequent change of the medium to remove unbound viral particles.

The predominant infection of polysialic acid bearing cells and the very small infection of cells having CAR but no polysialic acid is shown for different amounts of viral particle containing preparations used. This result is shown in FIG. 9 for the embodiments of Ad-polySia binder viral particles ΔC307 (4) and ΔC414 (3).

When using wild-type adenovirus as a positive control, both HEK293 cells and HEK293-polySia+ cells, production of virus was found approximately to the same extent for each cell line, indicating no preference for one of the cell lines, i.e. no preference for the polysialic acid bearing cells.

FIGS. 10 to 13 show microscope pictures at the magnification indicated of cultivated cells, with the left hand microscopic pictures showing fluorescence images and the right hand pictures showing light microscopic pictures of the identical subject area, i.e. without excitation of fluorescence. For excitation of fluorescence, light of 485 nm was irradiated onto the cell samples, detection was at 530 nm, indicating GFP. For these analyses, HEK cells and HEK293-polySia+ cells that express surface-bound polysialic acid following cultivation under standard cell culture conditions to 80% confluence were contacted for 30 min with 100 μL of viral particles prepared directly from cell lysate by freezing and thawing without concentration via a CsCl gradient. Unbound viral particles were then removed by washing and medium exchange, and the cells were incubated for a further 48 h under cell culture conditions.

FIG. 10 shows HEK293 cells following contact with viral particles ΔC307 containing the K410A mutation. The fluorescence images of FIGS. 10A and 10C show that essentially no HEK293 cells present in the light microscopic pictures of FIGS. 10B and 10D, respectively, were infected by the viral particle of the invention.

In contrast, HEK293-polySia+ cells when contacted with the viral particles ΔC307 containing the K410A mutation were effectively infected. Fluorescence images of FIGS. 11A and 11C show individual HEK293-polySia+ cells, marked up by the inserted arrowheads, fluoresce, indicating presence of the viral particle. The fluorescing cells are also marked up by inserted arrowheads in the light microscopic pictures of FIGS. 11B and 11D.

FIG. 12 shows HEK293 cells, which do not express polysialic acid, following contact with viral particles ΔC414 containing the K410A mutation. The fluorescence images of FIGS. 12A and 12C show that essentially no HEK293 cells were infected by the viral particle. FIGS. 12B and 12D show the cells in light microscopy.

FIG. 13 shows that HEK293-polySia+ cells when contacted with the viral particles ΔC307 containing the K410A mutation were effectively infected. Fluorescent cells are marked up by arrowheads in the fluorescence images of FIGS. 13A and 13B as well as in light microscopic images of FIGS. 13C and 13D.

The results of FIGS. 10 to 13 demonstrate that the viral particles of the invention infect mammalian cells bearing cell surface bound polysialic acid and also CAR (HEK293-polySia+), whereas cells which bear CAR but no cell surface bound polysialic acid (HEK293) are essentially not infected, showing the significant specificity of the viral particles for cells bearing cell surface bound polysialic acid. In addition, these results show that infection of cells bearing cell surface bound polysialic acid by the viral particles results in amplification of the viral particle within the infected cells.

The predominance of infection of cells for those cells bearing cell surface bound polysialic acid, represented by HEK293-polySia+, over cells not bearing cell surface bound polysialic acid by viral particles that were produced in infected cells shows that the specificity of the viral particles for cells bearing cell surface bound polysialic acid is stable, i.e. inheritable, and allows for secondary infection of such cells by viral particles that are generated within cells that were primarily infected by viral particles.

Therefore, these results indicate that cells bearing cell surface bound polysialic acid can specifically be infected by the viral particles of the invention, e.g. essentially without infecting cells bearing CAR but no cell surface bound polysialic acid. The viral particles used for initial infection can also be termed primary viral particles. Further, the results show that the viral particles multiply within infected cells to generate secondary viral particles having the same specificity for infecting cells bearing cell surface bound polysialic acid. The stable inheritance of the specificity in secondary viral particles for cells bearing cell surface bound polysialic acid allows re-targeting of the secondary viral particles to cells bearing cell surface bound polysialic acid.

For fluorescence-activated cell sorting (FACS) analysis, HEK293 cells and HEK293-polySia+ cells after contacting with viral particles as described above were incubated in fresh culture medium for 48 h under cell culture conditions and brought into suspension by the treatment with Cell Dissociation Buffer, enzyme-free, PBS (available from Gibco®, USA) according to the manufacturer's guidelines. For detection of infected cells EGFP fluorescence was measured directly. For comparison, wild-type adenovirus containing the same EGFP cassette was used, and ΔC307 and ΔC414, both additionally bearing the K410A mutation. HEK293 cells were used for representing cells having the CAR receptor and essentially having no cell surface bound polysialic acid, and HEK293-polySia+ cells were used for representing tumour cells bearing cell surface bound polysialic acid.

The FACS results are shown in FIGS. 14A-14F, for wild-type adenovirus in A) HEK293 cells and B) in HEK293-polySia+ cells, both showing infection, for viral particles ΔC307 in C) HEK293 cells and D) in HEK293-polySia+ cells, of which essentially only HEK293-polySia+ cells were infected, and for viral particles ΔC414 in E) HEK293 cells and F) in HEK293-polySia+ cells, of which essentially only HEK293-polySia+ cells were infected. These results confirm the specificity of the viral particles of the invention for mammalian cells bearing cell surface bound polysialic acid.

FIGS. 15C and 15D show transmission electron microscopic pictures of the viral particles ΔC307 in comparison to wild-type adenovirus in FIGS. 15A and 15B. It can be seen that the viral particles of the invention have the overall shape of adenovirus and bear a ligand (indicated by arrows) attached to the penton protein, which ligand seems to locate at the penton protein in a position similar to the ligand visible on the wild-type adenovirus. In the wild-type, the knob domain and the shaft domain (pseudo-repeats) are indicated, in the viral particle of the invention, the shaft domain and the endosialidase domain (PBXD) are indicated. As the fiber protein of the wild-type adenovirus is replaced by the polySia-binder protein, it is assumed that the ligand seen in FIGS. 15C and 15D is the polySia-binder protein, which is present in the position of the fiber protein in the wild-type, and that the polySia-binder protein allows for formation of stable viral particles, e.g. stabilizing arrangement of penton proteins.

Example 3: Use of Adenoviral Particles Containing the PolySia-binder in the Treatment of Tumour For establishment of a mouse model of polySia-expressing human xenograft tumours, $1 \times 10^7$ human rhabdomyosarcoma cells (TE671) were injected s.c. into the flank of nude mice. Once the tumours had reached a palpable size of ±100 mm$^3$, virotherapy was applied by intratumoural infiltration of $5 \times 10^8$ ifu of the polySia-specific 307-Ad, or hTert-Ad as control, respectively.

Treatment was repeated after 10 days and tumour size was monitored each 3-4 days using a digital caliper. Size was calculated using the formula $V=(L \times B^2)/2$. The results are depicted in FIG. 16, wherein the polySia-binder (307-Ad) corresponding to SEQ ID NO: 3 was produced by the method steps described in Example 1 and viral particles were produced as described in Example 2. hTert-Ad, containing the wild-type fiber protein, was used as a control. The result shows that the viral particle containing the polySia-binder according to the invention (▲) retarded tumour growth to a significantly higher degree than the control viral particle having no polysialic acid-specificity (■).

This in vivo example shows that the polySia-binder of the invention when expressed on an adenoviral particle results in retardation of tumour growth of polysialic acid bearing tumour cells.

SEQUENCE LISTING (81 sequences)

SEQ ID NO: 1 - protein, 898 aa, Artificial Sequence
  Synthesized in a laboratory
  Chain (1)..(44): tail domain
  Chain (45)..(60): pseudo-repeats
MKRARPSEDTFNPVYPYDTETGPPTVPFLTPPFVSPNGFQESPPGVLSLRLSEPLVTSNGPGPTPTPTPTPTPTPTPTPTSGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 2 - protein, 1005 aa, Artificial Sequence
  Synthesized in a laboratory
  Repeat (45)..(168): pseudo-repeats
MKRARPSEDTFNPVYPYDTETGPPTVPFLTPPFVSPNGFQESPPGVLSLRLSEPLVTSNGMLALKMGNGLSLDEAGNLTSQNVTTVSPPLKKTKSNINLEISAPLTVTSEALTVAAAAPLMVAGNTLTMQSQAPLTVHDSKLSIATQGPLTVSEGKLALQTSGPLTTTGPTPTPTPTPTPTPTPTPTSGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 3 - protein, 1112 aa, Artificial Sequence
  Synthesized in a laboratory
  Repeat (45)..(274): pseudo-repeats
MKRARPSEDTFNPVYPYDTETGPPTVPFLTPPFVSPNGFQESPPGVLSLRLSEPLVTSNGMLALKMGNGLSLDEAGNLTSQNVTTVSPPLKKTKSNINLEISAPLTVTSEALTVAAAAPLMVAGNTLTMQSQAPLTVHDSKLSIATQGPLTVSEGKLALQTSGPLTTTDSSTLTITASPPLTTATGSLGIDLKEPIYTQNGKLGLKYGAPLHVTDDLNTLTVATGPGVTINNTSLQTKVTGALGFDSQGNMQLNVAGGLRIDSQNRRLILDVSYPGPTPTPTPTPTPTPTPTPTSGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 4 - protein, 1185 aa, Artificial Sequence
  Synthesized in a laboratory
  Chain (1)..(44): tail domain
  Repeat (45)..(347): pseudo-repeats
  Chain (348)..(368): linker
MKRARPSEDTFNPVYPYDTETGPPTVPFLTPPFVSPNGFQESPPGVLSLRLSEPLVTSNGMLALKMGNGLSLDEAGNLTSQNVTTVSPPLKKTKSNINLEISAPLTVTSEALTVAAAAPLMVAGNTLTMQSQAPLTVHDSKLSIATQGPLTVSEGKLALQTSGPLTTTDSSTLTITASPPLTTATGSLGIDLKEPIYTQNGKLGLKYGAPLHVTDDLNTLTVATGPGVTINNTSLQTKVTGALGFDSQGNMQLNVAGGLRIDSQNRRLILDVSYPFDAQNQLNLRLGQGPLFINSAHNLDINYNKGLYLFTASNNSKKLEVNLSTAKGLMFDATAIAINAGDGLEFGPGPTPTPTPTPTPTPTPTPTSGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 5 - protein, 771 aa, Artificial Sequence
  Synthesized in a laboratory
  Chain (666)..(771): C-terminal chaperone domain
GDGKTNDQDAVNAAMASGKRIDGAGATYKVSSLPDMERFYNTRFVWERLAGQPLYYVSKGFINGELYKITDNPYYNAWPQDKAFVYENVIYAPYMGSDRHGVSRLHVSWVKSGDDGQTWSTPEWLTDMHPDYPTVNYHCMSMGVCRNRLFAMIETRTLAKNELTNCALWDRPMSRSLHLTGGITKAANQRYATIHVPDHGLFVGDFVNFSNSAVTGVSGDMKVATVIDKDNFTVLTPNQQTSDLNNAGKNWHMGTSFHKSPWRKTDLGLIPRVTEVHSFATIDNNGFVMGYHQGDVAPREVGLFYFPDAFNSPSNYVRRQIPSEYEPDAAEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGDIVNSSVGVGSVVVKDSFIYYIFGGENHFNPMTYGDNKDKDPFKGHGHPTDIYCYKMQIANDNRVSRKFTYGATPGQAIPTFMGTDGIRNIPAPLYFSDNIVTEDTKVGHLTLKASTSANIRSEMQMEGEYGFIGKSVPKDKPTGQRLIICGGERTSSSSGAQITLHGSNSSKAKRITYNGNEHLFQGAPIMPAVDNQFAAGGPSNRFTTIYLGSDPVTTSDADHKYGISSINTKVLKAWSRVGFKQYGLNSEAERNLDSIHFGVLAQDIVAAFEAEGLDAIKYGIVSFEEGRYGVRYSEVLILEAAYTRHRLDKLEEMYATNKIS

SEQ ID NO: 6 - protein, 817 aa, Artificial Sequence
  Synthesized in a laboratory
GDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 7 - protein, 834 aa, Artificial Sequence
  Synthesized in a laboratory
  Chain (671)..(834): C-terminal chaperone domain
GDGVHDDTSALSELLSVATGGEKIDGRGLTFKVSTLPDVSRFKNARFLFERIPGQPLFYVSEDFIQGELFKITDTPWYNAWTQDKTFVYDNVIYAPFMAGDRHGVNNLHVAWVRSGDDGKTWTTPEWLTDLHENYPTVNYHCMSMGVVRNRLFAVIETRTVSGNKLQVAELWDRPMSRSLRVYGGITKAANQQVAYIRITDHGLFAGDFVNFSNSGVTGVTGNMTVTTVIDKNTFTVTTQNTQDVDQNNEGRYWSFGTSFHSSPWRKTSLGTIPSFVDGSTPVTEIHSFATISDNSFAVGYHNGDIGPRELGILYFSDAFGSPGSFVRRRIPAEYEANASEPCVKYYDGILYLTTRGTLSTQPGSSLHRSSDLGTSWNSLRFPNNVHHSNLPFAKVGDELIIFGSERAFGEWEGGEPDNRYAGNYPRTFMTRVNVNEWSLDNVEWVNVTDQIYQGGIVNSAVGVGSVCIKDNWLYYIFGGEDFLNPWSIGDNNRKYPYVHDGHPADLYCFRVKIKQEEFVSRDFVYGATPNRTLPTFMSTSGVRTVPVPVDFTDDVAVQSLTVHAGTSGQVRAEVKLEGNYAIIAKKVPSDDVTAQRLIVSGGETTSSADGAMITLHGSRSSTPRRAVYNALEHLFENGDVKPYLDNVNALGGPGNRFSIVYLGSNPVVTSDGTLKTEPVSPDETLLDAWGDVRYIAYKWLNAVAIKGEEGARIHHGVIAQQLRDVLISHGLMEEESTTCRYAFLCYDDYPAVYDDVITGQREMPLTDNDGSIIVDEDDNPVMVMEDIIERVEITPAGSRWGVRPDLLFYIEAAWQRREIERIKARLDLIEGKH

SEQ ID NO: 8 - protein, 679 aa, Artificial Sequence
  Synthesized in a laboratory
GDGATDDTNAITQLLAAMPDGWIIDGRNLTFKVTTLPDISKFKNAAFVYERIVGQPLTYVSEGFFDGNLTKITDTPFYNAWTQDKTFVYDNVIYAPFMAGERHGVQNLHVAWVKSGDDGQTWSMPEWLTPIHPDYTADKVNYHCMSMGVCGNRLYAVIETRYLSNMRLKKAELWSRPMPYYRRPTGGITISSGSTTATIVLKKHGLKVGDAVNFSNSGATGVSGNMTVASVINKDTFTVTLARAATSNIDNTGTTWHFGTRFWDSPWEITELPDVAYSTNADLCVTETHSFTVIDDDNYTFAVGYHNGDISPRRLGILYFNNAYSDPSSFTRRTISQEYADNAAEPCIKYYDGILYLTTRGTSTSAAGSTLAMSADLGENWNYLRFPNNVHHTNLPFAKVGDYLYIFGTERSFGEWEGQELDNRYKGTYPRTFMCKINVSSWPVSLSNVQWFNITDQIYQGHIVNSACGVGSVCVKDGWLYYIFGGEDFLSPWSIGDNSKKLWYKHDGHPADLYSYRLKITEHDFVSRDFKYGATPNRTLPVSMGTDGVRHVSAPVTFDNDVQMYSLTVTGLEHDGTQQSAVRVKLDGDYGVIAKNIPIKNPSEQRLILCGGETPYTTDGSLLQLYGSNHTYPNRAILYAPGGAYTQNNFMPYLDGQVSLGGASNRWSEVYASTGTINT

SEQ ID NO: 9 - protein, 817 aa, Artificial Sequence
  Synthesized in a laboratory
  Chain (666)..(817): C-terminal chaperone domain
GDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAANALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 10 - protein, 817 aa, Artificial Sequence
  Synthesized in a laboratory
GDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAKNALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITAGTRGDRLGSSLHRSRDIGQTWESLRFPHNVHHTTLPFAKVGDDLIMFGSEAAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 11 - DNA, 132 bp, Artificial Sequence
  Synthesized in a laboratory
  CDS (1)..(132): fiber tail domain
atgaagcgcgcaagaccgtctgaagataccttcaaccccgtgtatccatatgacacggaaaccggtcctccaactgtgccttttcttactcctccctttgtatcccccaatgggtttcaagagagtccccct

SEQ ID NO: 12 - protein, 44 aa, Artificial Sequence
  Synthetic Construct
MKRARPSEDTFNPVYPYDTETGPPTVPFLTPPFVSPNGFQESPP

SEQ ID NO: 13 - protein, 44 aa, Artificial Sequence; identical to SEQ ID NO: 12
  Synthesized in a laboratory

SEQ ID NO: 14 - DNA, 45 bp, Artificial Sequence
  Synthesized in a laboratory
  CDS (1)..(45): fiber shaft pseudo repeat
ggggtactctctttgcgcctatccgaacctctagttacctccaat

SEQ ID NO: 15 - protein, 15 aa, Artificial Sequence
  Synthetic Construct
GVLSLRLSEPLVTSN

SEQ ID NO: 16 - protein, 15 aa, Artificial Sequence
  Synthesized in a laboratory
GVLSLRLSEPLVTSN

SEQ ID NO: 17 - DNA, 63 bp, Artificial Sequence
  Synthesized in a laboratory
  CDS (1)..(63): linker PT8P
cccgggccgaccccaaccccaactccaacgccgacgccgaccccgactcctactcccactagt

SEQ ID NO: 18 - protein, 21 aa, Artificial Sequence
  Synthetic Construct
PGPTPTPTPTPTPTPTPTPTS

SEQ ID NO: 19 - protein, 21 aa, Artificial Sequence
  Synthesized in a laboratory
PGPTPTPTPTPTPTPTPTPTS

SEQ ID NO: 20 - DNA, 39 bp, Artificial Sequence
  Synthesized in a laboratory
  CDS (1)..(39): Linker S3N10
tccagctccaataacaataacaacaacaataacaataac

SEQ ID NO: 21 - protein, 13 aa, Artificial Sequence
  Synthetic Construct
SSSNNNNNNNNNN

SEQ ID NO: 22 - protein, 13 aa, Artificial Sequence
  Synthesized in a laboratory
SSSNNNNNNNNNN

SEQ ID NO: 23 - DNA, 2451 bp, Artificial Sequence
  CDS 1..2451
  CDS (1)..(2451): DeltaN247-Endo-K1F (codon optimized hAd5)
ggcgatggtgtcacggatgataccgccgctctcaccagcgctttgaatgatactccggttggtcagaagattaacggtaatggtaagacttacaaagtcaccagtttgcccgacatatccagattcatcaatacccgttttgtgtatgagcggattccaggccagcccctgtactacgcctctgaggagttcgtgcaaggtgaactgtttaagataacagacaccccctactacaatgcctggccccaggataaagccttcgtgtacgaaaacgtcatctacgccccttatatgggttctgacagacacggcgtctcgcgcctccacgtgtcatgggtgaaatccggagatgacggccagacctggagcacccctgagtggctcactgacttgcaccccgattacccaacagtaaactatcattgcatgtccatgggggtttgccggaaccgcctttttgccatgattgaaactcgtactcttgctaagaacgctctgactaactgcgccctttgggacaggccgatgtcgcggagccttcacctgactggcgggattactaaggctgctaaccaacgctatgcaactatccacgttccggaccacggactgtttgtgggcgactttgttaacttttccaactccgccgtaacaggggtttctggagatatgacagtcgcgaccgtgatcgataaggacaactttaccgtgctaactcccaaccagcagaccagcgatctcaataacgccggtaaaaattggcacatgggtacaagctttcacaaatccccttggagaaagaccgaccttggccttatcccttctgtcaccgaagttcacagctttgctaccattgacaataacggctttgccatgggttaccaccaaggagacgttgctccgcgcgaggtggggctgttttacttccctgacgcctttaactcgccttccaactacgttaggcgccaaatacccagcgagtacgagccggatgcaagtgagccttgcataaaatattatgatggcgtcctatacctaataacacgtggcaccagaggggaccgcctcggttcgtcgctccaccgttcgcgagacataggtcagacatgggagagcctccgtttcccgcacaacgttcaccatactactctgcctttcgctaaggtgggcgatgatctcatcatgtttgggtctgagcgggcggagaacgaatgggaagccggtgccccagatgatcgctacaaggccagttacccccggacattctacgcgcggctgaacgtgaataactggaacgcagacgatatcgaatgggtgaacattactgatcagatctatcagggcgggattgttaacagcggcgttggtgtcggctccgtggtggttaaggacaattacatatactacatgtttggcggtgaagaccacttcaacccatggacctacggtgataatagtgcgaaggaccctttcaagtcggatggccacccgtctgacttgtactgctacaaaatgaagatcggaccagacaaccgcgtatcccgagattttagatatggtgccgttcccaatcgcgcggtgccggtcttcttcgacactaacggcgtccgcaccgtccctgccccgatggagttcaccggtgacctcggacttggtcatgtaaccattcgcgcgtccacctcttccaacattcggtctgaggttttgatggaaggagaatacggctttattggcaaatctattccaacagacaatcccgccggtcagcgcattattttctgtggcggcgaaggaaccagtagtaccaccggcgcacaaattactctttacggcgcgaataacacagattctagaaggatagtgtacaacggtgatgaacaccttttccagtccgcggacgtgaaaccttacaacgataatgtcactgcccttggagggccttcgaataggttcaccacagcctaccttggctccaaccccatcgtgacttccaatggcgagaggaaaacggagcctgtcgtttttgacgacgcttttcttgacgcttggggtgatgtccactatattatgtaccagtggctcgatgctgttcaactaaagggcaacgacgctcgcatacatttcggagtgattgcccagcagatccgggacgtgtttatagctcatggtctgatggatgagaatagcacgaactgccgttacgcggtactatgctatgataagtatcccaggatgactgacaccgtattttctcacaatgaaatcgttgagcataccgacgaggagggcaacgttacaaccactgaggaacctgtgtacaccgaggtagttatacacgaggagggggaagaatggggggtgcgccccgatgggattttttttgctgaagccgcataccaacgccggaagctggaacggattgaggccaggctgtcagcgttggagcagaaa

SEQ ID NO: 24 - protein, 817 aa, Artificial Sequence; identical to SEQ ID NO: 6
  Synthetic Construct

SEQ ID NO: 25 - protein, 817 aa, Artificial Sequence; identical to SEQ ID NO: 6
  Synthesized in a laboratory

SEQ ID NO: 26 - DNA, 2313 bp, Artificial Sequence
  Synthesized in a laboratory
  CDS (1)..(2313): DeltaN40-Endo-K1E (codon optimized hAd5)
ggcgacggcaagaccaacgaccaggacgccgtgaacgccgccatggccagcggcaagcgcattgacggcgccggcgccacctacaaggtgagcagcctgcccgacatggagcgcttttacaacacccgctttgtgtgggagcgcctggccggccagcccctgtactacgtgagcaagggctttattaacggcgagctgtacaagattaccgacaacccctactacaacgcctggccccaggacaaggcctttgtgtacgagaacgtgatttacgccccctacatgggcagcgaccgccacggcgtgagccgcctgcacgtgagctgggtgaagagcggcgacgacggccagacctggagcacccccgagtggctgaccgacatgcaccccgactaccccaccgtgaactaccactgcatgagcatgggcgtgtgccgcaaccgcctgtttgccatgattgagacccgcaccctggccaagaacgagctgaccaactgcgccctgtgggaccgccccatgagccgcagcctgcacctgaccggcggcattaccaaggccgccaaccagcgctacgccaccattcacgtgcccgaccacggcctgtttgtgggcgactttgtgaactttagcaacagcgccgtgaccggcgtgagcggcgacatgaaggtggccaccgtgattgacaaggacaactttaccgtgctgacccccaaccagcagaccagcgacctgaacaacgccggcaagaactggcacatgggcaccagctttcacaagagcccctggcgcaagaccgacctgggcctgattccccgcgtgaccgaggtgcacagctttgccaccattgacaacaacggctttgtgatgggctaccaccagggcgacgtggccccccgcgaggtgggcctgttttactttcccgacgcctttaacagccccagcaactacgtgcgccgccagattcccagcgagtacgagcccgacgccgccgagccctgcattaagtactacgacggcgtgctgtacctgattacccgcggcacccgcggcgaccgcctgggcagcagcctgcaccgcagccgcgacattggccagacctgggagagcctgcgctttccccacaacgtgcaccacaccaccctgccctttgccaaggtgggcgacgacctgattatgtttggcagcgagcgcgccgagaacgagtgggaggccggcgcccccgacgaccgctacaaggccagctacccccgcaccttttacgcccgcctgaacgtgaacaactggaacgccgacgacattgagtgggtgaacattaccgaccagatttaccagggcgacattgtgaacagcagcgtgggcgtgggcagcgtggtggtgaaggacagctttatttactacatttttggcggcgagaaccactttaaccccatgacctacggcgacaacaaggacaaggacccctttaagggccacggccaccccaccgacatttactgctacaagatgcagattgccaacgacaaccgcgtgagccgcaagtttacctacggcgccacccccggccaggccattcccacctttatgggcaccgacggcattcgcaacattcccgcccccctgtactttagcgacaacattgtgaccgaggacaccaaggtgggccacctgaccctgaaggccagcaccagcgccaacattcgcagcgagatgcagatggagggcgagtacggctttattggcaagagcgtgcccaaggacaagcccaccggccagcgcctgattatttgcggcggcgagcgcaccagcagcagcagcggcgcccagattaccctgcacggcagcaacagcagcaaggccaagcgcattacctacaacggcaacgagcacctgtttcagggcgcccccattatgcccgccgtggacaaccagtttgccgccggcggccccagcaaccgctttaccaccatttacctgggcagcgaccccgtgaccaccagcgacgccgaccacaagtacggcattagcagcattaacaccaaggtgctgaaggcctggagccgcgtgggctttaagcagtacggcctgaacagcgaggccgagcgcaacctggacagcattcactttggcgtgctggcccaggacattgtggccgcctttgaggccgagggcctggacgccattaagtacggcattgtgagctttgaggagggccgctacggcgtgcgctacagcgaggtgctgattctggaggccgcctacacccgccaccgcctggacaagctggaggagatgtacgccaccaacaagattagc

SEQ ID NO: 27 - protein, 771 aa, Artificial Sequence; identical to SEQ ID NO: 5
  Synthetic Construct

SEQ ID NO: 28 - protein, 771 aa, Artificial Sequence; identical to SEQ ID NO: 5
  Synthesized in a laboratory

SEQ ID NO: 29 - DNA, 2502 bp, Artificial Sequence
  CDS 1..2502
  CDS (1)..(2502): DeltaN147-Endo-NK1 (CUS3) (codon optimized hAd5)
ggcgacggcgtgcacgacgacaccagcgccctgagcgagctgctgagcgtggccaccggcggcgagaagattgacggccgcggcctgacctttaaggtgagcaccctgcccgacgtgagccgctttaagaacgcccgctttctgtttgagcgcattcccggccagcccctgttttacgtgagcgaggactttattcagggcgagctgtttaagattaccgacaccccctggtacaacgcctggacccaggacaagacctttgtgtacgacaacgtgatttacgccccctttatggccggcgaccgccacggcgtgaacaacctgcacgtggcctgggtgcgcagcggcgacgacggcaagacctggaccacccccgagtggctgaccgacctgcacgagaactaccccaccgtgaactaccactgcatgagcatgggcgtggtgcgcaaccgcctgtttgccgtgattgagacccgcaccgtgagcggcaacaagctgcaggtggccgagctgtgggaccgccccatgagccgcagcctgcgcgtgtacggcggcattaccaaggccgccaaccagcaggtggcctacattcgcattaccgaccacggcctgtttgccggcgactttgtgaactttagcaacagcggcgtgaccggcgtgaccggcaacatgaccgtgaccaccgtgattgacaagaacacctttaccgtgaccacccagaacacccaggacgtggaccagaacaacgagggccgctactggagctttggcaccagctttcacagcagcccctggcgcaagaccagcctgggcaccattcccagctttgtggacggcagcacccccgtgaccgagattcacagctttgccaccattagcgacaacagctttgccgtgggctaccacaacggcgacattggcccccgcgagctgggcattctgtactttagcgacgcctttggcagccccggcagctttgtgcgccgccgcattcccgccgagtacgaggccaacgccagcgagccctgcgtgaagtactacgacggcattctgtacctgaccacccgcggcaccctgagcacccagcccggcagcagcctgcaccgcagcagcgacctgggcaccagctggaacagcctgcgctttcccaacaacgtgcaccacagcaacctgccctttgccaaggtgggcgacgagctgattatttttggcagcgagcgcgcctttggcgagtgggagggcggcgagcccgacaaccgctacgccggcaactacccccgcacctttatgacccgcgtgaacgtgaacgagtggagcctggacaacgtggagtgggtgaacgtgaccgaccagatttaccagggcggcattgtgaacagcgccgtgggcgtgggcagcgtgtgcattaaggacaactggctgtactacatttttggcggcgaggactttctgaacccctggagcattggcgacaacaaccgcaagtacccctacgtgcacgacggccaccccgccgacctgtactgctttcgcgtgaagattaagcaggaggagtttgtgagccgcgactttgtgtacggcgccacccccaaccgcaccctgcccacctttatgagcaccagcggcgtgcgcaccgtgcccgtgcccgtggactttaccgacgacgtggccgtgcagagcctgaccgtgcacgccggcaccagcggccaggtgcgcgccgaggtgaagctggagggcaactacgccattattgccaagaaggtgcccagcgacgacgtgaccgcccagcgcctgattgtgagcggcggcgagaccaccagcagcgccgacggcgccatgattaccctgcacggcagccgcagcagcaccccccgccgcgccgtgtacaacgccctggagcacctgtttgagaacggcgacgtgaagccctacctggacaacgtgaacgccctgggcggccccggcaaccgctttagcattgtgtacctgggcagcaaccccgtggtgaccagcgacggcaccctgaagaccgagcccgtgagccccgacgagaccctgctggacgcctggggcgacgtgcgctacattgcctacaagtggctgaacgccgtggccattaagggcgaggagggcgcccgcattcaccacggcgtgattgcccagcagctgcgcgacgtgctgattagccacggcctgatggaggaggagagcaccacctgccgctacgcctttctgtgctacgacgactaccccgccgtgtacgacgacgtgattaccggccagcgcgagatgcccctgaccgacaacgacggcagcattattgtggacgaggacgacaaccccgtgatggtgatggaggacattattgagcgcgtggagattacccccgccggcagccgctggggcgtgcgccccgacctgctgttttacattgaggccgcctggcagcgccgcgagattgagcgcattaaggcccgcctggacctgattgagggcaagcac

SEQ ID NO: 30 - protein, 834 aa, Artificial Sequence; identical to SEQ ID NO: 7
  Synthetic Construct

SEQ ID NO: 31 - protein, 834 aa, Artificial Sequence; identical to SEQ ID NO: 7
  Synthesized in a laboratory

SEQ ID NO: 32 - DNA, 2037 bp, Artificial Sequence
  CDS 1..2037
  CDS (1)..(2037): DeltaN76-Endo-Phi92 (codon optimized hAd5)
ggcgacggcgccaccgacgacaccaacgccattacccagctgctggccgccatgcccgacggctggattattgacggccgcaacctgacctttaaggtgaccaccctgcccgacattagcaagtttaagaacgccgcctttgtgtacgagcgcattgtgggccagcccctgacctacgtgagcgagggcttttttgacggcaacctgaccaagattaccgacacccccttttacaacgcctggacccaggacaagacctttgtgtacgacaacgtgatttacgccccctttatggccggcgagcgccacggcgtgcagaacctgcacgtggcctgggtgaagagcggcgacgacggccagacctggagcatgcccgagtggctgacccccattcaccccgactacaccgccgacaaggtgaactaccactgcatgagcatgggcgtgtgcggcaaccgcctgtacgccgtgattgagacccgctacctgagcaacatgcgcctgaagaaggccgagctgtggagccgccccatgccctactaccgccgccccaccggcggcattaccattagcagcggcagcaccaccgccaccattgtgctgaagaagcacggcctgaaggtgggcgacgccgtgaactttagcaacagcggcgccaccggcgtgagcggcaacatgaccgtggccagcgtgattaacaaggacacctttaccgtgaccctggcccgcgccgccaccagcaacattgacaacaccggcaccacctggcactttggcacccgcttttgggacagcccctgggagattaccgagctgcccgacgtggcctacagcaccaacgccgacctgtgcgtgaccgagacccacagctttaccgtgattgacgacgacaactacacctttgccgtgggctaccacaacggcgacattagcccccgccgcctgggcattctgtactttaacaacgcctacagcgaccccagcagctttacccgccgcaccattagccaggagtacgccgacaacgccgccgagccctgcattaagtactacgacggcattctgtacctgaccacccgcggcaccagcaccagcgccgccggcagcaccctggccatgagcgccgacctgggcgagaactggaactacctgcgctttcccaacaacgtgcaccacaccaacctgccctttgccaaggtgggcgactacctgtacatttttggcaccgagcgcagctttggcgagtgggagggccaggagctggacaaccgctacaagggcacctacccccgcacctttatgtgcaagattaacgtgagcagctggcccgtgagcctgagcaacgtgcagtggtttaacattaccgaccagatttaccagggccacattgtgaacagcgcctgcggcgtgggcagcgtgtgcgtgaaggacggctggctgtactacatttttggcggcgaggactttctgagcccctggagcattggcgacaacagcaagaagctgtggtacaagcacgacggccaccccgccgacctgtacagctaccgcctgaagattaccgagcacgactttgtgagccgcgactttaagtacggcgccacccccaaccgcaccctgcccgtgagcatgggcaccgacggcgtgcgccacgtgagcgcccccgtgacctttgacaacgacgtgcagatgtacagcctgaccgtgaccggcctggagcacgacggcacccagcagagcgccgtgcgcgtgaagctggacggcgactacggcgtgattgccaagaacattcccattaagaaccccagcgagcagcgcctgattctgtgcggcggcgagaccccctacaccaccgacggcagcctgctgcagctgtacggcagcaaccacacctaccccaaccgcgccattctgtacgcccccggcggcgcctacacccagaacaactttatgccctacctggacggccaggtgagcctgggcggcgccagcaaccgctggagcgaggtgtacgccagcaccggcaccattaacacc

SEQ ID NO: 33 - protein, 679 aa, Artificial Sequence; identical to SEQ ID NO: 8
  Synthetic Construct

SEQ ID NO: 34 - protein, 679 aa, Artificial Sequence; identical to SEQ ID NO: 8
  Synthesized in a laboratory

SEQ ID NO: 35 - DNA, 255 bp, Artificial Sequence
  Synthesized in a laboratory
ctgcgctgtcggggccaggccgggctcccagtggattcgcgggcacagacgcccaggaccgcgcttcccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcag

SEQ ID NO: 36 - DNA, 418 bp, Artificial Sequence
  Synthesized in a laboratory
agatcgaactgtaacactattccaatcacatttatctttcaggcggcggtggagatggcaacctcgctggaacgcgctgggagcctgagcccgcagccggagacgcactgctccttgtgctccaccgcccgccacgccgccgcgcagaccctccatcttccatttcagctccgggccaggctcgaccctgccccggggtggggtagggagcgggctctccgcttctctcggggctccaggtcgttctccacccccgggccctctgcgactcaattgcctggtcccccctcccccgccacacacactcacacgcgcccgcgagcacacacgcacgcacacaacacactcacacgccagcaggctgctggccgctcaatggaccgatttccccggtttccctgaacccagctagcccggg

SEQ ID NO: 37 - DNA, 1447 bp, Artificial Sequence
  Synthesized in a laboratory
ctagaacctcgggttttaagcaagggtcatgtctttctacttaatgctgctccttgagtcactctgaattcttcctaagtccaaggatacccaaatcctggtggtgagccttctcatttgctgatgtggaaagtgcaaactttaatgggctaatggactagcaaaggtactgctcagtgaaggagcaggaagtcagacttcagagcctctggaatcctggggccaaggcacacagataggaaggagtctggtttccaggctctgtctcctgctgaggaagcatgtagatgttaggtgtgataagcctgagcagtcagctctcttgaatgtgccagaaactaggaatggagaggtgctcagctagaatactcagaaagcgcgccagctgcacaatacaatagaagtaaaaaaaaaaaaaaaaaaaaaaaggtaggcgggaagaggggtgaaaatcagagcccaatacacttcagttggattttcaagaggagcctgcctttcctgctttttacccttcctttcttcttccctaggattacgaatgtgttggtgggtgtgccggaggacgctgccttttctcagaattctggtctcagcagtgaagtttaaatggcattggatttgccttcacttcgtgaggagtttccaaacgacaacgcgtgggtcacagaagtgtccataatgttcgtaaggatgcctccgacttcacttgcttacctcaagcttcaagctgggatcctcattacccatccactctgcgggcgagatcagctcatcagctcctgtgaataatcgtattttccagacagagttgtgcactgaataatgaacgttccccttccacttccctgttggatttcactgtgcttcggtcgggtttattcgcccgtgcgtttacgtatgtttagcaaacacgctttgaatgataggctgctttctcgagctatccttatccctagccattgcgttcctctggtgggatgagtctcatctttctcagatgagatgaatgctggtgtcgaagctggcggatctggagccttgacgtttgggcgtcctaggagatagtgtggttctgtgtgtgtctgtggtttgggggcatgtgcggcaagaagcgtccgcgtgcgactgtgagcttcctccacccggcatagtgcagaccgagctcacaacgactctccgagcagccgccagtaacgcaaggcaacagcagcctccgccccctcagcaccgtgattggctggccttgcttatcgtttccctgctacggcgaggaaagggccagtgacgcccccgagcccagctgcagaagaaaccgccacctccaatgcacaaggtgtcacatttgaaaagaaacctgagccccagggaggcgggccagagcgaccccggcccggtaacgctaactgcgcggcaggctgggcagcgctggagaaccgggagagct

SEQ ID NO: 38 - DNA, 19 bp, Artificial Sequence
  Synthesized in a laboratory
ggaagacgcggaggctctc

SEQ ID NO: 39 - DNA, 43 bp, Artificial Sequence
  Synthesized in a laboratory
tcttgaaacccattgggggatacaaagggaggagtaagaaaag

SEQ ID NO: 40 - DNA, 39 bp, Artificial Sequence
  Synthesized in a laboratory
ttcttactcctccctttgtatcccccaatgggtttcaag

SEQ ID NO: 41 - DNA, 39 bp, Artificial Sequence
  Synthesized in a laboratory
tcatccgtgacaccatcgccactagtgggagtaggagtc

SEQ ID NO: 42 - DNA, 39 bp, Artificial Sequence
  Synthesized in a laboratory
cgactcctactcccactagtggcgatggtgtcacggatg

SEQ ID NO: 43 - DNA, 39 bp, Artificial Sequence
  Synthesized in a laboratory
agctccagcctacacaattatttctgctccaacgctgac

SEQ ID NO: 44 - DNA, 39 bp, Artificial Sequence
  Synthesized in a laboratory
cagcgttggagcagaaataattgtgtaggctggagctgc

SEQ ID NO: 45 - DNA, 36 bp, Artificial Sequence
  Synthesized in a laboratory
gggctatactactgaatgaatatcctccttagttcc

SEQ ID NO: 46 - DNA, 39 bp, Artificial Sequence
  Synthesized in a laboratory
gaactaaggaggatattcattcagtagtatagccccacc

SEQ ID NO: 47 - DNA, 30 bp, Artificial Sequence
  Synthesized in a laboratory
ggatcgcggccgcccccatgtaggcgtgga

SEQ ID NO: 48 - DNA, 32 bp, Artificial Sequence
  Synthesized in a laboratory
ttaaggtacggtgatctgtataagctatgtgg

SEQ ID NO: 49 - protein, 771 aa, Artificial Sequence
  Synthesized in a laboratory
GDGKTNDQDAVNAAMASGKRIDGAGATYKVSSLPDMERFYNTRFVWERLAGQPLYYVSKGFINGELYKITDNPYYNAWPQDKAFVYENVIYAPYMGSDRHGVSRLHVSWVKSGDDGQTWSTPEWLTDMHPDYPTVNYHCMSMGVCRNRLFAMIETRTLAANELTNCALWDRPMSRSLHLTGGITKAANQRYATIHVPDHGLFVGDFVNFSNSAVTGVSGDMKVATVIDKDNFTVLTPNQQTSDLNNAGKNWHMGTSFHKSPWRKTDLGLIPRVTEVHSFATIDNNGFVMGYHQGDVAPREVGLFYFPDAFNSPSNYVRRQIPSEYEPDAAEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGDIVNSSVGVGSVVVKDSFIYYIFGGENHFNPMTYGDNKDKDPFKGHGHPTDIYCYKMQIANDNRVSRKFTYGATPGQAIPTFMGTDGIRNIPAPLYFSDNIVTEDTKVGHLTLKASTSANIRSEMQMEGEYGFIGKSVPKDKPTGQRLIICGGERTSSSSGAQITLHGSNSSKAKRITYNGNEHLFQGAPIMPAVDNQFAAGGPSNRFTTIYLGSDPVTTSDADHKYGISSINTKVLKAWSRVGFKQYGLNSEAERNLDSIHFGVLAQDIVAAFEAEGLDAIKYGIVSFEEGRYGVRYSEVLILEAAYTRHRLDKLEEMYATNKIS

SEQ ID NO: 50 - protein, 771 aa, Artificial Sequence
  Synthesized in a laboratory
GDGKTNDQDAVNAAMASGKRIDGAGATYKVSSLPDMERFYNTRFVWERLAGQPLYYVSKGFINGELYKITDNPYYNAWPQDKAFVYENVIYAPYMGSDRHGVSRLHVSWVKSGDDGQTWSTPEWLTDMHPDYPTVNYHCMSMGVCRNRLFAMIETRTLAKNELTNCALWDRPMSRSLHLTGGITKAANQRYATIHVPDHGLFVGDFVNFSNSAVTGVSGDMKVATVIDKDNFTVLTPNQQTSDLNNAGKNWHMGTSFHKSPWRKTDLGLIPRVTEVHSFATIDNNGFVMGYHQGDVAPREVGLFYFPDAFNSPSNYVRRQIPSEYEPDAAEPCIKYYDGVLYLITAGTRGDRLGSSLHRSRDIGQTWESLRFPHNVHHTTLPFAKVGDDLIMFGSEAAENEWEAGAPDDRYKASYPRTFYARLNVNNWNADDIEWVNITDQIYQGDIVNSSVGVGSVVVKDSFIYYIFGGENHFNPMTYGDNKDKDPFKGHGHPTDIYCYKMQIANDNRVSRKFTYGATPGQAIPTFMGTDGIRNIPAPLYFSDNIVTEDTKVGHLTLKASTSANIRSEMQMEGEYGFIGKSVPKDKPTGQRLIICGGERTSSSSGAQITLHGSNSSKAKRITYNGNEHLFQGAPIMPAVDNQFAAGGPSNRFTTIYLGSDPVTTSDADHKYGISSINTKVLKAWSRVGFKQYGLNSEAERNLDSIHFGVLAQDIVAAFEAEGLDAIKYGIVSFEEGRYGVRYSEVLILEAAYTRHRLDKLEEMYATNKIS

SEQ ID NO: 51 - protein, 834 aa, Artificial Sequence
  Synthesized in a laboratory
GDGVHDDTSALSELLSVATGGEKIDGRGLTFKVSTLPDVSRFKNARFLFERIPGQPLFYVSEDFIQGELFKITDTPWYNAWTQDKTFVYDNVIYAPFMAGDRHGVNNLHVAWVRSGDDGKTWTTPEWLTDLHENYPTVNYHCMSMGVVRNRLFAVIETRTVSGNKLQVAELWDRPMSRSLRVYGGITKAANQQVAYIRITDHGLFAGDFVNFSNSGVTGVTGNMTVTTVIDKNTFTVTTQNTQDVDQNNEGRYWSFGTSFHSSPWRKTSLGTIPSFVDGSTPVTEIHSFATISDNSFAVGYHNGDIGPRELGILYFSDAFGSPGSFVRRRIPAEYEANASEPCVKYYDGILYLTTAGTLSTQPGSSLHRSSDLGTSWNSLRFPNNVHHSNLPFAKVGDELIIFGSEAAFGEWEGGEPDNRYAGNYPRTFMTRVNVNEWSLDNVEWVNVTDQIYQGGIVNSAVGVGSVCIKDNWLYYIFGGEDFLNPWSIGDNNRKYPYVHDGHPADLYCFRVKIKQEEFVSRDFVYGATPNRTLPTFMSTSGVRTVPVPVDFTDDVAVQSLTVHAGTSGQVRAEVKLEGNYAIIAKKVPSDDVTAQRLIVSGGETTSSADGAMITLHGSRSSTPRRAVYNALEHLFENGDVKPYLDNVNALGGPGNRFSIVYLGSNPVVTSDGTLKTEPVSPDETLLDAWGDVRYIAYKWLNAVAIKGEEGARIHHGVIAQQLRDVLISHGLMEEESTTCRYAFLCYDDYPAVYDDVITGQREMPLTDNDGSIIVDEDDNPVMVMEDIIERVEITPAGSRWGVRPDLLFYIEAAWQRREIERIKARLDLIEGKH

SEQ ID NO: 52 - protein, 679 aa, Artificial Sequence
  Synthesized in a laboratory
GDGATDDTNAITQLLAAMPDGWIIDGRNLTFKVTTLPDISKFKNAAFVYERIVGQPLTYVSEGFFDGNLTKITDTPFYNAWTQDKTFVYDNVIYAPFMAGERHGVQNLHVAWVKSGDDGQTWSMPEWLTPIHPDYTADKVNYHCMSMGVCGNRLYAVIETRYLSNMRLKKAELWSRPMPYYRRPTGGITISSGSTTATIVLKKHGLKVGDAVNFSNSGATGVSGNMTVASVINKDTFTVTLARAATSNIDNTGTTWHFGTRFWDSPWEITELPDVAYSTNADLCVTETHSFTVIDDDNYTFAVGYHNGDISPRRLGILYFNNAYSDPSSFTRRTISQEYADNAAEPCIKYYDGILYLTTAGTSTSAAGSTLAMSADLGENWNYLRFPNNVHHTNLPFAKVGDYLYIFGTEASFGEWEGQELDNRYKGTYPRTFMCKINVSSWPVSLSNVQWFNITDQIYQGHIVNSACGVGSVCVKDGWLYYIFGGEDFLSPWSIGDNSKKLWYKHDGHPADLYSYRLKITEHDFVSRDFKYGATPNRTLPVSMGTDGVRHVSAPVTFDNDVQMYSLTVTGLEHDGTQQSAVRVKLDGDYGVIAKNIPIKNPSEQRLILCGGETPYTTDGSLLQLYGSNHTYPNRAILYAPGGAYTQNNFMPYLDGQVSLGGASNRWSEVYASTGTINT

SEQ ID NO: 53 - DNA, 38421 bp, Artificial Sequence
  Synthesized in a laboratory
  promoter (343)..(760): mus musculus ST8SiaII minimal promoter
  gene (761)..(1833): E1A
  CDS (28053)..(28331): C-terminally truncated E3 12.5K
  variation (28332)..(28358): 2.7 kb deletion plus different sequence from wild-type
  CDS (28359)..(28379): N-terminally truncated E3 14.7K
  misc_feature (28582)..(29622): Delta 235 C-terminally truncated fiber shaft
  CDS (28582)..(32136): Delta C235 fiber (PT)8 EndoNF K410A
  misc_feature (29623)..(29685): linker (PT)8P
  misc_feature (29686)..(32136): EndoNF K410A
  3'UTR (32137)..(32265): 3'-UTR fiber
  gene (32265)..(32348): selection cassette
  misc_feature (32288)..(32321): FRT site
  misc_feature (35433)..(38421): prokaryotic vector backbone
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaataagatcgaactgtaacactattccaatcacatttatctttcaggcggcggtggagatggcaacctcgctggaacgcgctgggagcctgagcccgcagccggagacgcactgctccttgtgctccaccgcccgccacgccgccgcgcagaccctccatcttccatttcagctccgggccaggctcgaccctgccccggggtggggtagggagcgggctctccgcttctctcggggctccaggtcgttctccacccccgggccctctgcgactcaattgcctggtcccccctcccccgccacacacactcacacgcgcccgcgagcacacacgcacgcacacaacacactcacacgccagcaggctgctggccgctcaatggaccgatttccccggtttccctgaacccagctagcccgggatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatcctctagttataactagagtacccggggatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggtcccgggccgaccccaaccccaactccaacgccgacgccgaccccgactcctactcccactagtggcgatggtgtcacggatgataccgccgctctcaccagcgctttgaatgatactccggttggtcagaagattaacggtaatggtaagacttacaaagtcaccagtttgcccgacatatccagattcatcaatacccgttttgtgtatgagcggattccaggccagcccctgtactacgcctctgaggagttcgtgcaaggtgaactgtttaagataacagacaccccctactacaatgcctggccccaggataaagccttcgtgtacgaaaacgtcatctacgccccttatatgggttctgacagacacggcgtctcgcgcctccacgtgtcatgggtgaaatccggagatgacggccagacctggagcacccctgagtggctcactgacttgcaccccgattacccaacagtaaactatcattgcatgtccatgggggtttgccggaaccgcctttttgccatgattgaaactcgtactcttgctgccaacgctctgactaactgcgccctttgggacaggccgatgtcgcggagccttcacctgactggcgggattactaaggctgctaaccaacgctatgcaactatccacgttccggaccacggactgtttgtgggcgactttgttaacttttccaactccgccgtaacaggggtttctggagatatgacagtcgcgaccgtgatcgataaggacaactttaccgtgctaactcccaaccagcagaccagcgatctcaataacgccggtaaaaattggcacatgggtacaagctttcacaaatccccttggagaaagaccgaccttggccttatcccttctgtcaccgaagttcacagctttgctaccattgacaataacggctttgccatgggttaccaccaaggagacgttgctccgcgcgaggtggggctgttttacttccctgacgcctttaactcgccttccaactacgttaggcgccaaatacccagcgagtacgagccggatgcaagtgagccttgcataaaatattatgatggcgtcctatacctaataacacgtggcaccagaggggaccgcctcggttcgtcgctccaccgttcgcgagacataggtcagacatgggagagcctccgtttcccgcacaacgttcaccatactactctgcctttcgctaaggtgggcgatgatctcatcatgtttgggtctgagcgggcggagaacgaatgggaagccggtgccccagatgatcgctacaaggccagttacccccggacattctacgcgcggctgaacgtgaataactggaacgcagacgatatcgaatgggtgaacattactgatcagatctatcagggcgggattgttaacagcggcgttggtgtcggctccgtggtggttaaggacaattacatatactacatgtttggcggtgaagaccacttcaacccatggacctacggtgataatagtgcgaaggaccctttcaagtcggatggccacccgtctgacttgtactgctacaaaatgaagatcggaccagacaaccgcgtatcccgagattttagatatggtgccgttcccaatcgcgcggtgccggtcttcttcgacactaacggcgtccgcaccgtccctgccccgatggagttcaccggtgacctcggacttggtcatgtaaccattcgcgcgtccacctcttccaacattcggtctgaggttttgatggaaggagaatacggctttattggcaaatctattccaacagacaatcccgccggtcagcgcattattttctgtggcggcgaaggaaccagtagtaccaccggcgcacaaattactctttacggcgcgaataacacagattctagaaggatagtgtacaacggtgatgaacaccttttccagtccgcggacgtgaaaccttacaacgataatgtcactgcccttggagggccttcgaataggttcaccacagcctaccttggctccaaccccatcgtgacttccaatggcgagaggaaaacggagcctgtcgtttttgacgacgcttttcttgacgcttggggtgatgtccactatattatgtaccagtggctcgatgctgttcaactaaagggcaacgacgctcgcatacatttcggagtgattgcccagcagatccgggacgtgtttatagctcatggtctgatggatgagaatagcacgaactgccgttacgcggtactatgctatgataagtatcccaggatgactgacaccgtattttctcacaatgaaatcgttgagcataccgacgaggagggcaacgttacaaccactgaggaacctgtgtacaccgaggtagttatacacgaggagggggaagaatggggggtgcgccccgatgggattttttttgctgaagccgcataccaacgccggaagctggaacggattgaggccaggctgtcagcgttggagcagaaataaagaatcgtttgtgttatgtttcaacgtgtttatttttcaattgcagaaaatttcaagtcatttttcattcagtagtatagccccaccaccacatagcttatacagatcaccgtaccttaatcaaacttgtgtaggctggagctgcttcgaagttcctatactttctagagaataggaacttcggaataggaactaaggaggatattcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgttacatcgttaattaacgatttcgaacccggggtaccgaattcctcgagtctagaggagcatgcgacgtcgcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctagttaattaacgttaattaa

SEQ ID NO: 54 - protein, 93 aa, Artificial Sequence
  Synthetic Construct
MLSGEAEQLRLKHLVHCRRHKCFARDSGEFCYFELPEDHIEGPAHGVRLTAQGELARSLIREFTQRPLLVERDRGPCVLTVICNCPNPGLHQD

SEQ ID NO: 55 - protein, 6 aa, Artificial Sequence
  Synthetic Construct
DLIPFN

SEQ ID NO: 56 - protein, 1185 aa, Artificial Sequence
  Synthetic Construct
MKRARPSEDTFNPVYPYDTETGPPTVPFLTPPFVSPNGFQESPPGVLSLRLSEPLVTSNGMLALKMGNGLSLDEAGNLTSQNVTTVSPPLKKTKSNINLEISAPLTVTSEALTVAAAAPLMVAGNTLTMQSQAPLTVHDSKLSIATQGPLTVSEGKLALQTSGPLTTTDSSTLTITASPPLTTATGSLGIDLKEPIYTQNGKLGLKYGAPLHVTDDLNTLTVATGPGVTINNTSLQTKVTGALGFDSQGNMQLNVAGGLRIDSQNRRLILDVSYPFDAQNQLNLRLGQGPLFINSAHNLDINYNKGLYLFTASNNSKKLEVNLSTAKGLMFDATAIAINAGDGLEFGPGPTPTPTPTPTPTPTPTPTSGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAANALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 57 - protein, 93 aa, Artificial Sequence; identical to SEQ ID NO: 54
  Synthesized in a laboratory

SEQ ID NO: 58 - protein, 6 aa, Artificial Sequence
  Synthesized in a laboratory
DLIPFN

SEQ ID NO: 59 - protein, 1185 aa, Artificial Sequence; identical to SEQ ID NO: 56
  Synthesized in a laboratory

SEQ ID NO: 60 - DNA, 39450 bp, Artificial Sequence
  Synthesized in a laboratory
  promoter (343)..(1789): ST8SiaIV promoter
  promoter (1281)..(1789): truncated ST8SiaIV promoter, truncation variant II
  promoter (1510)..(1789): truncated ST8SiaIV promoter, truncation variant I
  gene (1790)..(2862): E1A
  gene (29082)..(29360): C-terminally truncated E3
  gene (29361)..(29408): N-terminally truncated E3 14.7K
  misc_feature (29611)..(30651): Delta 235 C-terminally truncated fiber
  CDS (29611)..(33165): fiber-endosialidase
  misc_feature (30652)..(30714): (PT)8P linker
  misc_feature (30715)..(33165): endo NF (Ad5) K410A
  3'UTR (33166)..(33294): 3'-UTR fiber
  gene (33294)..(33377): selection cassette
  misc_feature (33317)..(33350): FRT site
  misc_feature (36462)..(39450): prokaryotic vector backbone
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactagaacctcgggttttaagcaagggtcatgtctttctacttaatgctgctccttgagtcactctgaattcttcctaagtccaaggatacccaaatcctggtggtgagccttctcatttgctgatgtggaaagtgcaaactttaatgggctaatggactagcaaaggtactgctcagtgaaggagcaggaagtcagacttcagagcctctggaatcctggggccaaggcacacagataggaaggagtctggtttccaggctctgtctcctgctgaggaagcatgtagatgttaggtgtgataagcctgagcagtcagctctcttgaatgtgccagaaactaggaatggagaggtgctcagctagaatactcagaaagcgcgccagctgcacaatacaatagaagtaaaaaaaaaaaaaaaaaaaaaaaggtaggcgggaagaggggtgaaaatcagagcccaatacacttcagttggattttcaagaggagcctgcctttcctgctttttacccttcctttcttcttccctaggattacgaatgtgttggtgggtgtgccggaggacgctgccttttctcagaattctggtctcagcagtgaagtttaaatggcattggatttgccttcacttcgtgaggagtttccaaacgacaacgcgtgggtcacagaagtgtccataatgttcgtaaggatgcctccgacttcacttgcttacctcaagcttcaagctgggatcctcattacccatccactctgcgggcgagatcagctcatcagctcctgtgaataatcgtattttccagacagagttgtgcactgaataatgaacgttccccttccacttccctgttggatttcactgtgcttcggtcgggtttattcgcccgtgcgtttacgtatgtttagcaaacacgctttgaatgataggctgctttctcgagctatccttatccctagccattgcgttcctctggtgggatgagtctcatctttctcagatgagatgaatgctggtgtcgaagctggcggatctggagccttgacgtttgggcgtcctaggagatagtgtggttctgtgtgtgtctgtggtttgggggcatgtgcggcaagaagcgtccgcgtgcgactgtgagcttcctccacccggcatagtgcagaccgagctcacaacgactctccgagcagccgccagtaacgcaaggcaacagcagcctccgccccctcagcaccgtgattggctggccttgcttatcgtttccctgctacggcgaggaaagggccagtgacgcccccgagcccagctgcagaagaaaccgccacctccaatgcacaaggtgtcacatttgaaaagaaacctgagccccagggaggcgggccagagcgaccccggcccggtaacgctaactgcgcggcaggctgggcagcgctggagaaccgggagagctatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatcctctagttataactagagtacccggggatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggtcccgggccgaccccaaccccaactccaacgccgacgccgaccccgactcctactcccactagtggcgatggtgtcacggatgataccgccgctctcaccagcgctttgaatgatactccggttggtcagaagattaacggtaatggtaagacttacaaagtcaccagtttgcccgacatatccagattcatcaatacccgttttgtgtatgagcggattccaggccagcccctgtactacgcctctgaggagttcgtgcaaggtgaactgtttaagataacagacaccccctactacaatgcctggccccaggataaagccttcgtgtacgaaaacgtcatctacgccccttatatgggttctgacagacacggcgtctcgcgcctccacgtgtcatgggtgaaatccggagatgacggccagacctggagcacccctgagtggctcactgacttgcaccccgattacccaacagtaaactatcattgcatgtccatgggggtttgccggaaccgcctttttgccatgattgaaactcgtactcttgctgccaacgctctgactaactgcgccctttgggacaggccgatgtcgcggagccttcacctgactggcgggattactaaggctgctaaccaacgctatgcaactatccacgttccggaccacggactgtttgtgggcgactttgttaacttttccaactccgccgtaacaggggtttctggagatatgacagtcgcgaccgtgatcgataaggacaactttaccgtgctaactcccaaccagcagaccagcgatctcaataacgccggtaaaaattggcacatgggtacaagctttcacaaatccccttggagaaagaccgaccttggccttatcccttctgtcaccgaagttcacagctttgctaccattgacaataacggctttgccatgggttaccaccaaggagacgttgctccgcgcgaggtggggctgttttacttccctgacgcctttaactcgccttccaactacgttaggcgccaaatacccagcgagtacgagccggatgcaagtgagccttgcataaaatattatgatggcgtcctatacctaataacacgtggcaccagaggggaccgcctcggttcgtcgctccaccgttcgcgagacataggtcagacatgggagagcctccgtttcccgcacaacgttcaccatactactctgcctttcgctaaggtgggcgatgatctcatcatgtttgggtctgagcgggcggagaacgaatgggaagccggtgccccagatgatcgctacaaggccagttacccccggacattctacgcgcggctgaacgtgaataactggaacgcagacgatatcgaatgggtgaacattactgatcagatctatcagggcgggattgttaacagcggcgttggtgtcggctccgtggtggttaaggacaattacatatactacatgtttggcggtgaagaccacttcaacccatggacctacggtgataatagtgcgaaggaccctttcaagtcggatggccacccgtctgacttgtactgctacaaaatgaagatcggaccagacaaccgcgtatcccgagattttagatatggtgccgttcccaatcgcgcggtgccggtcttcttcgacactaacggcgtccgcaccgtccctgccccgatggagttcaccggtgacctcggacttggtcatgtaaccattcgcgcgtccacctcttccaacattcggtctgaggttttgatggaaggagaatacggctttattggcaaatctattccaacagacaatcccgccggtcagcgcattattttctgtggcggcgaaggaaccagtagtaccaccggcgcacaaattactctttacggcgcgaataacacagattctagaaggatagtgtacaacggtgatgaacaccttttccagtccgcggacgtgaaaccttacaacgataatgtcactgcccttggagggccttcgaataggttcaccacagcctaccttggctccaaccccatcgtgacttccaatggcgagaggaaaacggagcctgtcgtttttgacgacgcttttcttgacgcttggggtgatgtccactatattatgtaccagtggctcgatgctgttcaactaaagggcaacgacgctcgcatacatttcggagtgattgcccagcagatccgggacgtgtttatagctcatggtctgatggatgagaatagcacgaactgccgttacgcggtactatgctatgataagtatcccaggatgactgacaccgtattttctcacaatgaaatcgttgagcataccgacgaggagggcaacgttacaaccactgaggaacctgtgtacaccgaggtagttatacacgaggagggggaagaatggggggtgcgccccgatgggattttttttgctgaagccgcataccaacgccggaagctggaacggattgaggccaggctgtcagcgttggagcagaaataaagaatcgtttgtgttatgtttcaacgtgtttatttttcaattgcagaaaatttcaagtcatttttcattcagtagtatagccccaccaccacatagcttatacagatcaccgtaccttaatcaaacttgtgtaggctggagctgcttcgaagttcctatactttctagagaataggaacttcggaataggaactaaggaggatattcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgttacatcgttaattaacgatttcgaacccggggtaccgaattcctcgagtctagaggagcatgcgacgtcgcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctagttaattaacgttaattaa

SEQ ID NO: 61 - protein, 1185 aa, Artificial Sequence; identical to SEQ ID NO: 56
  Synthetic Construct

SEQ ID NO: 62 - protein, 1185 aa, Artificial Sequence
  Synthesized in a laboratory
MKRARPSEDTFNPVYPYDTETGPPTVPFLTPPFVSPNGFQESPPGVLSFVSPNGFQESPPGVLSKMGNGLSLDEAGNLTSQNVTTVSPPLKKTKSNINLEISAPLTVTSEALTVAAAAPLMVAGNTLTMQSQAPLTVHDSKLSIATQGPLTVSEGKLALQTSGPLTTTDSSTLTITASPPLTTATGSLGIDLKEPIYTQNGKLGLKYGAPLHVTDDLNTLTVATGPGVTINNTSLQTKVTGALGFDSQGNMQLNVAGGLRIDSQNRRLILDVSYPFDAQNQLNLRLGQGPLFINSAHNLDINYNKGLYLFTASNNSKKLEVNLSTAKGLMFDATAIAINAGDGLEFGPGPTPTPTPTPTPTPTPTPTSGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAANALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 63 - DNA, 38286 bp, Artificial Sequence
  Synthesized in a laboratory
  promoter (343)..(597): homo sapiens telomerase core promoter
  TATA_signal (598)..(625): TATA box
  gene (626)..(1698): E1A
  gene (27918)..(28196): C-terminally truncated E3 12.5K
  variation (28197)..(28223): 2.7 kb deletion plus different sequence from wild-type
  gene (28224)..(28244): N-terminally truncated E3 14.7K
  misc_feature (28447)..(29487): Delta 235 C-terminally truncated fiber
  CDS (28447)..(32001): fiber Endosialidase
  misc_feature (29488)..(29550): Linker (PT)8P
  misc_feature (29551)..(32001): endoNF(Ad5)-K410A
  3'UTR (32002)..(32130): 3'-UTR fiber
  gene (32130)..(32186): FRT site
  misc_feature (35298)..(38286): prokaryotic vector backbone
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactgcgctgtcggggccaggccgggctcccagtggattcgcgggcacagacgcccaggaccgcgcttcccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcagacgtgtagtgtatttatacccggtgagtatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatcctctagttataactagagtacccggggatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggtcccgggccgaccccaaccccaactccaacgccgacgccgaccccgactcctactcccactagtggcgatggtgtcacggatgataccgccgctctcaccagcgctttgaatgatactccggttggtcagaagattaacggtaatggtaagacttacaaagtcaccagtttgcccgacatatccagattcatcaatacccgttttgtgtatgagcggattccaggccagcccctgtactacgcctctgaggagttcgtgcaaggtgaactgtttaagataacagacaccccctactacaatgcctggccccaggataaagccttcgtgtacgaaaacgtcatctacgccccttatatgggttctgacagacacggcgtctcgcgcctccacgtgtcatgggtgaaatccggagatgacggccagacctggagcacccctgagtggctcactgacttgcaccccgattacccaacagtaaactatcattgcatgtccatgggggtttgccggaaccgcctttttgccatgattgaaactcgtactcttgctgccaacgctctgactaactgcgccctttgggacaggccgatgtcgcggagccttcacctgactggcgggattactaaggctgctaaccaacgctatgcaactatccacgttccggaccacggactgtttgtgggcgactttgttaacttttccaactccgccgtaacaggggtttctggagatatgacagtcgcgaccgtgatcgataaggacaactttaccgtgctaactcccaaccagcagaccagcgatctcaataacgccggtaaaaattggcacatgggtacaagctttcacaaatccccttggagaaagaccgaccttggccttatcccttctgtcaccgaagttcacagctttgctaccattgacaataacggctttgccatgggttaccaccaaggagacgttgctccgcgcgaggtggggctgttttacttccctgacgcctttaactcgccttccaactacgttaggcgccaaatacccagcgagtacgagccggatgcaagtgagccttgcataaaatattatgatggcgtcctatacctaataacacgtggcaccagaggggaccgcctcggttcgtcgctccaccgttcgcgagacataggtcagacatgggagagcctccgtttcccgcacaacgttcaccatactactctgcctttcgctaaggtgggcgatgatctcatcatgtttgggtctgagcgggcggagaacgaatgggaagccggtgccccagatgatcgctacaaggccagttacccccggacattctacgcgcggctgaacgtgaataactggaacgcagacgatatcgaatgggtgaacattactgatcagatctatcagggcgggattgttaacagcggcgttggtgtcggctccgtggtggttaaggacaattacatatactacatgtttggcggtgaagaccacttcaacccatggacctacggtgataatagtgcgaaggaccctttcaagtcggatggccacccgtctgacttgtactgctacaaaatgaagatcggaccagacaaccgcgtatcccgagattttagatatggtgccgttcccaatcgcgcggtgccggtcttcttcgacactaacggcgtccgcaccgtccctgccccgatggagttcaccggtgacctcggacttggtcatgtaaccattcgcgcgtccacctcttccaacattcggtctgaggttttgatggaaggagaatacggctttattggcaaatctattccaacagacaatcccgccggtcagcgcattattttctgtggcggcgaaggaaccagtagtaccaccggcgcacaaattactctttacggcgcgaataacacagattctagaaggatagtgtacaacggtgatgaacaccttttccagtccgcggacgtgaaaccttacaacgataatgtcactgcccttggagggccttcgaataggttcaccacagcctaccttggctccaaccccatcgtgacttccaatggcgagaggaaaacggagcctgtcgtttttgacgacgcttttcttgacgcttggggtgatgtccactatattatgtaccagtggctcgatgctgttcaactaaagggcaacgacgctcgcatacatttcggagtgattgcccagcagatccgggacgtgtttatagctcatggtctgatggatgagaatagcacgaactgccgttacgcggtactatgctatgataagtatcccaggatgactgacaccgtattttctcacaatgaaatcgttgagcataccgacgaggagggcaacgttacaaccactgaggaacctgtgtacaccgaggtagttatacacgaggagggggaagaatggggggtgcgccccgatgggattttttttgctgaagccgcataccaacgccggaagctggaacggattgaggccaggctgtcagcgttggagcagaaataaagaatcgtttgtgttatgtttcaacgtgtttatttttcaattgcagaaaatttcaagtcatttttcattcagtagtatagccccaccaccacatagcttatacagatcaccgtaccttaatcaaacttgtgtaggctggagctgcttcgaagttcctatactttctagagaataggaacttcggaataggaactaaggaggatattcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgttacatcgttaattaacgatttcgaacccggggtaccgaattcctcgagtctagaggagcatgcgacgtcgcaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctagttaattaacgttaattaa

SEQ ID NO: 64 - protein, 1185 aa, Artificial Sequence; identical to SEQ ID NO: 56
  Synthetic Construct

SEQ ID NO: 65 - protein, 1185 aa, Artificial Sequence; identical to SEQ ID NO: 56
  Synthesized in a laboratory

SEQ ID NO: 66 - DNA, 35297 bp, Artificial Sequence
  Synthesized in a laboratory
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactgcgctgtcggggccaggccgggctcccagtggattcgcgggcacagacgcccaggaccgcgcttcccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcagacgtgtagtgtatttatacccggtgagtatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatcctctagttataactagagtacccggggatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggtcccgggccgaccccaaccccaactccaacgccgacgccgaccccgactcctactcccactagtggcgatggtgtcacggatgataccgccgctctcaccagcgctttgaatgatactccggttggtcagaagattaacggtaatggtaagacttacaaagtcaccagtttgcccgacatatccagattcatcaatacccgttttgtgtatgagcggattccaggccagcccctgtactacgcctctgaggagttcgtgcaaggtgaactgtttaagataacagacaccccctactacaatgcctggccccaggataaagccttcgtgtacgaaaacgtcatctacgccccttatatgggttctgacagacacggcgtctcgcgcctccacgtgtcatgggtgaaatccggagatgacggccagacctggagcacccctgagtggctcactgacttgcaccccgattacccaacagtaaactatcattgcatgtccatgggggtttgccggaaccgcctttttgccatgattgaaactcgtactcttgctgccaacgctctgactaactgcgccctttgggacaggccgatgtcgcggagccttcacctgactggcgggattactaaggctgctaaccaacgctatgcaactatccacgttccggaccacggactgtttgtgggcgactttgttaacttttccaactccgccgtaacaggggtttctggagatatgacagtcgcgaccgtgatcgataaggacaactttaccgtgctaactcccaaccagcagaccagcgatctcaataacgccggtaaaaattggcacatgggtacaagctttcacaaatccccttggagaaagaccgaccttggccttatcccttctgtcaccgaagttcacagctttgctaccattgacaataacggctttgccatgggttaccaccaaggagacgttgctccgcgcgaggtggggctgttttacttccctgacgcctttaactcgccttccaactacgttaggcgccaaatacccagcgagtacgagccggatgcaagtgagccttgcataaaatattatgatggcgtcctatacctaataacacgtggcaccagaggggaccgcctcggttcgtcgctccaccgttcgcgagacataggtcagacatgggagagcctccgtttcccgcacaacgttcaccatactactctgcctttcgctaaggtgggcgatgatctcatcatgtttgggtctgagcgggcggagaacgaatgggaagccggtgccccagatgatcgctacaaggccagttacccccggacattctacgcgcggctgaacgtgaataactggaacgcagacgatatcgaatgggtgaacattactgatcagatctatcagggcgggattgttaacagcggcgttggtgtcggctccgtggtggttaaggacaattacatatactacatgtttggcggtgaagaccacttcaacccatggacctacggtgataatagtgcgaaggaccctttcaagtcggatggccacccgtctgacttgtactgctacaaaatgaagatcggaccagacaaccgcgtatcccgagattttagatatggtgccgttcccaatcgcgcggtgccggtcttcttcgacactaacggcgtccgcaccgtccctgccccgatggagttcaccggtgacctcggacttggtcatgtaaccattcgcgcgtccacctcttccaacattcggtctgaggttttgatggaaggagaatacggctttattggcaaatctattccaacagacaatcccgccggtcagcgcattattttctgtggcggcgaaggaaccagtagtaccaccggcgcacaaattactctttacggcgcgaataacacagattctagaaggatagtgtacaacggtgatgaacaccttttccagtccgcggacgtgaaaccttacaacgataatgtcactgcccttggagggccttcgaataggttcaccacagcctaccttggctccaaccccatcgtgacttccaatggcgagaggaaaacggagcctgtcgtttttgacgacgcttttcttgacgcttggggtgatgtccactatattatgtaccagtggctcgatgctgttcaactaaagggcaacgacgctcgcatacatttcggagtgattgcccagcagatccgggacgtgtttatagctcatggtctgatggatgagaatagcacgaactgccgttacgcggtactatgctatgataagtatcccaggatgactgacaccgtattttctcacaatgaaatcgttgagcataccgacgaggagggcaacgttacaaccactgaggaacctgtgtacaccgaggtagttatacacgaggagggggaagaatggggggtgcgccccgatgggattttttttgctgaagccgcataccaacgccggaagctggaacggattgaggccaggctgtcagcgttggagcagaaataaagaatcgtttgtgttatgtttcaacgtgtttatttttcaattgcagaaaatttcaagtcatttttcattcagtagtatagccccaccaccacatagcttatacagatcaccgtaccttaatcaaacttgtgtaggctggagctgcttcgaagttcctatactttctagagaataggaacttcggaataggaactaaggaggatattcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 67 - protein, 289 aa, Artificial Sequence
  Synthesized in a laboratory
MRHIICHGGVITEEMAASLLDQLIEEVLADNLPPPSHFEPPTLHELYDLDVTAPEDPNEEAVSQIFPDSVMLAVQEGIDLLTFPPAPGSPEPPHLSRQPEQPEQRALGPVSMPNLVPEVIDLTCHEAGFPPSDDEDEEGEEFVLDYVEHPGHGCRSCHYHRRNTGDPDIMCSLCYMRTCGMFVYSPVSEPEPEPEPEPEPARPTRRPKMAPAILRRPTSPVSRECNSSTDSCDSGPSNTPPEIHPVVPLCPIKPVAVRVGGRRQAVECIEDLLNEPGQPLDLSCKRPRP

SEQ ID NO: 68 - protein, 93 aa, Artificial Sequence; identical to SEQ ID NO: 54
  Synthesized in a laboratory

SEQ ID NO: 69 - protein, 6 aa, Artificial Sequence
  Synthesized in a laboratory
DLIPFN

SEQ ID NO: 70 - protein, 1185 aa, Artificial Sequence; identical to SEQ ID NO: 56
  Synthesized in a laboratory

SEQ ID NO: 71 - protein, 21 aa, Artificial Sequence
  Synthesized in a laboratory
PGPTPTPTPTPTPTPTPTPTS

SEQ ID NO: 72 - DNA, 35078 bp, Artificial Sequence
  Synthesized in a laboratory
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactgcgctgtcggggccaggccgggctcccagtggattcgcgggcacagacgcccaggaccgcgcttcccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcagacgtgtagtgtatttatacccggtgagtatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatcctctagttataactagagtacccggggatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatcccgggccgaccccaaccccaactccaacgccgacgccgaccccgactcctactcccactagtggcgatggtgtcacggatgataccgccgctctcaccagcgctttgaatgatactccggttggtcagaagattaacggtaatggtaagacttacaaagtcaccagtttgcccgacatatccagattcatcaatacccgttttgtgtatgagcggattccaggccagcccctgtactacgcctctgaggagttcgtgcaaggtgaactgtttaagataacagacaccccctactacaatgcctggccccaggataaagccttcgtgtacgaaaacgtcatctacgccccttatatgggttctgacagacacggcgtctcgcgcctccacgtgtcatgggtgaaatccggagatgacggccagacctggagcacccctgagtggctcactgacttgcaccccgattacccaacagtaaactatcattgcatgtccatgggggtttgccggaaccgcctttttgccatgattgaaactcgtactcttgctgccaacgctctgactaactgcgccctttgggacaggccgatgtcgcggagccttcacctgactggcgggattactaaggctgctaaccaacgctatgcaactatccacgttccggaccacggactgtttgtgggcgactttgttaacttttccaactccgccgtaacaggggtttctggagatatgacagtcgcgaccgtgatcgataaggacaactttaccgtgctaactcccaaccagcagaccagcgatctcaataacgccggtaaaaattggcacatgggtacaagctttcacaaatccccttggagaaagaccgaccttggccttatcccttctgtcaccgaagttcacagctttgctaccattgacaataacggctttgccatgggttaccaccaaggagacgttgctccgcgcgaggtggggctgttttacttccctgacgcctttaactcgccttccaactacgttaggcgccaaatacccagcgagtacgagccggatgcaagtgagccttgcataaaatattatgatggcgtcctatacctaataacacgtggcaccagaggggaccgcctcggttcgtcgctccaccgttcgcgagacataggtcagacatgggagagcctccgtttcccgcacaacgttcaccatactactctgcctttcgctaaggtgggcgatgatctcatcatgtttgggtctgagcgggcggagaacgaatgggaagccggtgccccagatgatcgctacaaggccagttacccccggacattctacgcgcggctgaacgtgaataactggaacgcagacgatatcgaatgggtgaacattactgatcagatctatcagggcgggattgttaacagcggcgttggtgtcggctccgtggtggttaaggacaattacatatactacatgtttggcggtgaagaccacttcaacccatggacctacggtgataatagtgcgaaggaccctttcaagtcggatggccacccgtctgacttgtactgctacaaaatgaagatcggaccagacaaccgcgtatcccgagattttagatatggtgccgttcccaatcgcgcggtgccggtcttcttcgacactaacggcgtccgcaccgtccctgccccgatggagttcaccggtgacctcggacttggtcatgtaaccattcgcgcgtccacctcttccaacattcggtctgaggttttgatggaaggagaatacggctttattggcaaatctattccaacagacaatcccgccggtcagcgcattattttctgtggcggcgaaggaaccagtagtaccaccggcgcacaaattactctttacggcgcgaataacacagattctagaaggatagtgtacaacggtgatgaacaccttttccagtccgcggacgtgaaaccttacaacgataatgtcactgcccttggagggccttcgaataggttcaccacagcctaccttggctccaaccccatcgtgacttccaatggcgagaggaaaacggagcctgtcgtttttgacgacgcttttcttgacgcttggggtgatgtccactatattatgtaccagtggctcgatgctgttcaactaaagggcaacgacgctcgcatacatttcggagtgattgcccagcagatccgggacgtgtttatagctcatggtctgatggatgagaatagcacgaactgccgttacgcggtactatgctatgataagtatcccaggatgactgacaccgtattttctcacaatgaaatcgttgagcataccgacgaggagggcaacgttacaaccactgaggaacctgtgtacaccgaggtagttatacacgaggagggggaagaatggggggtgcgccccgatgggattttttttgctgaagccgcataccaacgccggaagctggaacggattgaggccaggctgtcagcgttggagcagaaataaagaatcgtttgtgttatgtttcaacgtgtttatttttcaattgcagaaaatttcaagtcatttttcattcagtagtatagccccaccaccacatagcttatacagatcaccgtaccttaatcaaacttgtgtaggctggagctgcttcgaagttcctatactttctagagaataggaacttcggaataggaactaaggaggatattcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 73 - protein, 289 aa, Artificial Sequence; identical to SEQ ID NO: 67
  Synthesized in a laboratory

SEQ ID NO: 74 - protein, 93 aa, Artificial Sequence; identical to SEQ ID NO: 54
  Synthesized in a laboratory

SEQ ID NO: 75 - protein, 6 aa, Artificial Sequence
  Synthesized in a laboratory
DLIPFN

SEQ ID NO: 76 - protein, 1112 aa, Artificial Sequence
  Synthesized in a laboratory
MKRARPSEDTFNPVYPYDTETGPPTVPFLTPPFVSPNGFQESPPGVLSLRLSEPLVTSNGMLALKMGNGLSLDEAGNLTSQNVTTVSPPLKKTKSNINLEISAPLTVTSEALTVAAAAPLMVAGNTLTMQSQAPLTVHDSKLSIATQGPLTVSEGKLALQTSGPLTTTDSSTLTITASPPLTTATGSLGIDLKEPIYTQNGKLGLKYGAPLHVTDDLNTLTVATGPGVTINNTSLQTKVTGALGFDSQGNMQLNVAGGLRIDSQNRRLILDVSYPGPTPTPTPTPTPTPTPTPTSGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAANALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

SEQ ID NO: 77 - DNA, 34760 bp, Artificial Sequence
  Synthesized in a laboratory
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactgcgctgtcggggccaggccgggctcccagtggattcgcgggcacagacgcccaggaccgcgcttcccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcagacgtgtagtgtatttatacccggtgagtatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgccgttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaacagaaattaatcatgcagctgggagagtcctaaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcagccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggctagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactataacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatcctctagttataactagagtacccggggatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccacccccgggccgaccccaaccccaactccaacgccgacgccgaccccgactcctactcccactagtggcgatggtgtcacggatgataccgccgctctcaccagcgctttgaatgatactccggttggtcagaagattaacggtaatggtaagacttacaaagtcaccagtttgcccgacatatccagattcatcaatacccgttttgtgtatgagcggattccaggccagcccctgtactacgcctctgaggagttcgtgcaaggtgaactgtttaagataacagacaccccctactacaatgcctggccccaggataaagccttcgtgtacgaaaacgtcatctacgccccttatatgggttctgacagacacggcgtctcgcgcctccacgtgtcatgggtgaaatccggagatgacggccagacctggagcacccctgagtggctcactgacttgcaccccgattacccaacagtaaactatcattgcatgtccatgggggtttgccggaaccgcctttttgccatgattgaaactcgtactcttgctgccaacgctctgactaactgcgccctttgggacaggccgatgtcgcggagccttcacctgactggcgggattactaaggctgctaaccaacgctatgcaactatccacgttccggaccacggactgtttgtgggcgactttgttaacttttccaactccgccgtaacaggggtttctggagatatgacagtcgcgaccgtgatcgataaggacaactttaccgtgctaactcccaaccagcagaccagcgatctcaataacgccggtaaaaattggcacatgggtacaagctttcacaaatccccttggagaaagaccgaccttggccttatcccttctgtcaccgaagttcacagctttgctaccattgacaataacggctttgccatgggttaccaccaaggagacgttgctccgcgcgaggtggggctgttttacttccctgacgcctttaactcgccttccaactacgttaggcgccaaatacccagcgagtacgagccggatgcaagtgagccttgcataaaatattatgatggcgtcctatacctaataacacgtggcaccagaggggaccgcctcggttcgtcgctccaccgttcgcgagacataggtcagacatgggagagcctccgtttcccgcacaacgttcaccatactactctgcctttcgctaaggtgggcgatgatctcatcatgtttgggtctgagcgggcggagaacgaatgggaagccggtgccccagatgatcgctacaaggccagttacccccggacattctacgcgcggctgaacgtgaataactggaacgcagacgatatcgaatgggtgaacattactgatcagatctatcagggcgggattgttaacagcggcgttggtgtcggctccgtggtggttaaggacaattacatatactacatgtttggcggtgaagaccacttcaacccatggacctacggtgataatagtgcgaaggaccctttcaagtcggatggccacccgtctgacttgtactgctacaaaatgaagatcggaccagacaaccgcgtatcccgagattttagatatggtgccgttcccaatcgcgcggtgccggtcttcttcgacactaacggcgtccgcaccgtccctgccccgatggagttcaccggtgacctcggacttggtcatgtaaccattcgcgcgtccacctcttccaacattcggtctgaggttttgatggaaggagaatacggctttattggcaaatctattccaacagacaatcccgccggtcagcgcattattttctgtggcggcgaaggaaccagtagtaccaccggcgcacaaattactctttacggcgcgaataacacagattctagaaggatagtgtacaacggtgatgaacaccttttccagtccgcggacgtgaaaccttacaacgataatgtcactgcccttggagggccttcgaataggttcaccacagcctaccttggctccaaccccatcgtgacttccaatggcgagaggaaaacggagcctgtcgtttttgacgacgcttttcttgacgcttggggtgatgtccactatattatgtaccagtggctcgatgctgttcaactaaagggcaacgacgctcgcatacatttcggagtgattgcccagcagatccgggacgtgtttatagctcatggtctgatggatgagaatagcacgaactgccgttacgcggtactatgctatgataagtatcccaggatgactgacaccgtattttctcacaatgaaatcgttgagcataccgacgaggagggcaacgttacaaccactgaggaacctgtgtacaccgaggtagttatacacgaggagggggaagaatggggggtgcgccccgatgggattttttttgctgaagccgcataccaacgccggaagctggaacggattgaggccaggctgtcagcgttggagcagaaataaagaatcgtttgtgttatgtttcaacgtgtttatttttcaattgcagaaaatttcaagtcatttttcattcagtagtatagccccaccaccacatagcttatacagatcaccgtaccttaatcaaacttgtgtaggctggagctgcttcgaagttcctatactttctagagaataggaacttcggaataggaactaaggaggatattcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 78 - protein, 289 aa, Artificial Sequence; identical to SEQ ID NO: 67
  Synthesized in a laboratory

SEQ ID NO: 79 - protein, 93 aa, Artificial Sequence; identical to SEQ ID NO: 54
  Synthesized in a laboratory

SEQ ID NO: 80 - protein, 6 aa, Artificial Sequence
  Synthesized in a laboratory
DLIPFN

SEQ ID NO: 81 - protein, 1006 aa, Artificial Sequence
  Synthesized in a laboratory
MKRARPSEDTFNPVYPYDTETGPPTVPFLTPPFVSPNGFQESPPGVLSLRLSEPLVTSNGMLALKMGNGLSLDEAGNLTSQNVTTVSPPLKKTKSNINLEISAPLTVTSEALTVAAAAPLMVAGNTLTMQSQAPLTVHDSKLSIATQGPLTVSEGKLALQTSGPLTTTPGPTPTPTPTPTPTPTPTPTSGDGVTDDTAALTSALNDTPVGQKINGNGKTYKVTSLPDISRFINTRFVYERIPGQPLYYASEEFVQGELFKITDTPYYNAWPQDKAFVYENVIYAPYMGSDRHGVSRLHVSWVKSGDDGQTWSTPEWLTDLHPDYPTVNYHCMSMGVCRNRLFAMIETRTLAANALTNCALWDRPMSRSLHLTGGITKAANQRYATIHVPDHGLFVGDFVNFSNSAVTGVSGDMTVATVIDKDNFTVLTPNQQTSDLNNAGKNWHMGTSFHKSPWRKTDLGLIPSVTEVHSFATIDNNGFAMGYHQGDVAPREVGLFYFPDAFNSPSNYVRRQIPSEYEPDASEPCIKYYDGVLYLITRGTRGDRLGSSLHRSRDIGQTWESLRFPHNVHHTTLPFAKVGDDLIMFGSERAENEWEAGAPDDRYKASYPRTFYARLNVNNWNADDIEWVNITDQIYQGGIVNSGVGVGSVVVKDNYIYYMFGGEDHFNPWTYGDNSAKDPFKSDGHPSDLYCYKMKIGPDNRVSRDFRYGAVPNRAVPVFFDTNGVRTVPAPMEFTGDLGLGHVTIRASTSSNIRSEVLMEGEYGFIGKSIPTDNPAGQRIIFCGGEGTSSTTGAQITLYGANNTDSRRIVYNGDEHLFQSADVKPYNDNVTALGGPSNRFTTAYLGSNPIVTSNGERKTEPVVFDDAFLDAWGDVHYIMYQWLDAVQLKGNDARIHFGVIAQQIRDVFIAHGLMDENSTNCRYAVLCYDKYPRMTDTVFSHNEIVEHTDEEGNVTTTEEPVYTEVVIHEEGEEWGVRPDGIFFAEAAYQRRKLERIEARLSALEQK

The invention claimed is:

1. An adenoviral particle for use in the treatment of a tumour comprising a fusion protein comprising from N-terminus to C-terminus a tail domain of an adenoviral fiber protein which lacks the native knob domain and an amino acid sequence of an endosialidase of bacteriophage origin, wherein the endosialidase lacks its bacteriophage attachment domain, wherein the fusion protein specifically binds to polysialic acid.

2. The adenoviral particle of claim 1, wherein the endosialidase of bacteriophage origin which lacks its bacteriophage attachment domain is selected from amino acid sequences having a sequence identity of at least 51% to one of SEQ ID NO: 5, SEQ ID NO: 6, SEQ ID NO: 7, or SEQ ID NO: 8.

3. The adenoviral particle of claim 1, wherein the fusion protein further comprises at least 1 pseudo-repeat of SEQ ID NO: 14 which is arranged between the tail domain and the endosialidase.

4. The adenoviral particle of claim 1, wherein the tail domain comprises an amino acid sequence of amino acids 1 to 44 of SEQ ID NO: 4.

5. The adenoviral particle of claim 3, wherein a flexible linker peptide containing at least 2 repeats of one or more amino acid sequences selected from $(PT)_xP$, wherein X is 1 to 10, and $S_3N_{10}$ is arranged N-terminally to the endosialidase and C-terminally to the at least one pseudo-repeat.

6. The adenoviral particle of claim 1, wherein the fusion protein from N-terminus to C-terminus consists of the tail domain of an adenoviral fiber protein which lacks the native knob domain, at least one pseudo-repeat, a linker peptide, and one endosialidase of bacteriophage origin, wherein the endosialidase lacks its bacteriophage attachment domain.

7. The adenoviral particle of claim 2, wherein
SEQ ID NO: 5 contains at least one of the mutations: K200A, the mutation R386A and R437A;
SEQ ID NO: 6 contains at least one of the mutations: K410A, the mutation R596A and R647A;
SEQ ID NO: 7 contains at least one of the mutations: R503A and R554A; and
SEQ ID NO: 8 contains at least one of the mutations: R436A and R437A.

8. The adenoviral particle of claim 1, wherein the adenoviral particle is comprised of wild-type adenoviral proteins with the exception of the wild-type fiber protein.

9. The adenoviral particle of claim 8, wherein the wild-type adenoviral proteins are comprised of adenovirus C serotype 5 and wherein the adenoviral particle lacks the coding sequence for E3 protein.

10. The adenoviral particle of claim 1, wherein the tumour is selected from glioblastoma, medulloblastoma, rhabdomyosarcoma, small cell carcinoma, and small cell lung carcinoma.

11. The adenoviral particle of claim 1, containing DNA sequence encoding adenoviral early proteins.

12. The adenoviral particle of claim 11, wherein the DNA sequence encoding adenoviral early proteins is functionally arranged under the control of a polysialyltransferase promoter of mammalian origin or a telomerase promoter.

13. The adenoviral particle of claim 1, wherein the fusion protein comprises a sequence of at least 90% sequence identity to one of SEQ ID NO: 1, SEQ ID NO: 2, SEQ ID NO: 3, or SEQ ID NO: 4.

14. The adenoviral particle of claim 1, wherein the endosialidase has a reduced enzymatic activity on polysialic acid.

15. A method for producing an adenoviral particle of claim 1, wherein the method comprises expressing a DNA in a mammalian cell, the DNA encoding a fusion protein comprising from N-terminus to C-terminus a tail domain of an adenoviral fiber protein which lacks the native knob domain and an amino acid sequence of an endolsialidase of bacteriophage origin which lacks its bacteriophage attachment domain, wherein the fusion protein specifically binds to polysialic acid.

16. The method of claim 15, wherein the tail domain consists of amino acids No. 1 to 44 of SEQ ID NO: 4.

* * * * *